United States Patent 8,110,725 (POLYNUCLEOTIDES AND POLYPEPTIDES IN PLANTS) - sequence listing, part 2

SEQ ID NO: 1821 - DNA, 2915 bp, Oryza sativa
  Predicted polypeptide sequence is orthologous to G1950
ctcccgtcgctcggcgcgcggagcaaccgccgcatcaagctccgccgcttcatcatctccccctacgaccgccgatacagaatctgggagactttcctcatagttcttgtagtctactctgcgtgggtctcaccatttgaatttggcttcattccgaagcctacgggggctctagctacagccgacaatgtggtgaatgcattcttcgcggttgacatcattctgaccttctttgtggcttatttggataaaatgagctatatgcttgaagatgatccaaagaagatcgcatggcgttatagtaccacatggcttgttcttgacgtggcctccaccatcccatcagaatttgctcgcaggatactaccttcaaagcttaggtcatatggatttttcaacatgcttcgtctgtggcgtctccgcagagtcagctctctgttttctaggttggagaaggatagacacttcaattacttctgggttcgatgtgcaaagctcatttgtgtcacactttttgctgtgcactgtgcggcatgcttctactatcttcttgctgataggtaccccgtcccaacttctacgtggattggcaattacatggcagatttccatgaacggagcttatggattcgctacgtaacatcagtctattggtcaatcaccactcttaccaccgtgggctatggggatctacatgcagaaaatacaagggagatgatcttcaacattttctacatgctctttaaccttggtttgaccgcttatttgatcggtaacatgaccaatttggttgtccatggcactagtcgtactcgaaactatagggatacaatccaagcagcaacaagctttggagtaagaaatcagctaccacctcggctgcaagatcagatgatttcacatattagcttaaaatacaggacagattcagaaggtcttcaacaacaagagatccttgattcactgcctaaagctattaaatctagcatttctcaatatctgttcttccatctggttcaaaatgtttacctgtttcaaggagtctcaaatgatctgatttttcaactggtttcggagacccacgcggccgccctcccgcccggggaggatgtgattttgcagaatgaagcacccactgacttctacatcttagtttctggtagtgtggagttagtagagcagcaaaatggtgcagaccaggtgatacaagtggctacgtcaggagaggttgttggagaaattggggttctttgctacagacctcagctattcacagttcgaacaagatccttgtgccagttgttgcgtttgaatcgtacagcttttctcagcattgttcaatccaatgttggggatggaactatcataatgaacaaccttattcagttccttaaagagcagaaggagaacagtgtaatggctggtgtcgtaaaggagatagagagtatgctagctcggggaaatctggatttgccaattacactctgttttgcagtaactagaggagatgattttttgttgcatcaacttcttaagcgtggtatggatccaaatgagtcagataatgacgggcataccgcactgcatatagctgcttccaaaggaaacgagcaatgcgtcaggcttctattagaatatggagctgatccaaatgccagagactcagaaggaaaagttccactgtgggaagcgctgtgtgagaagcacgccgccgtcgtgcaactattagtcgaaggcggcgcggatctgtcgtcgggtgacacgggcttatacgcttgcatcgccgtggaggagagcgacaccgagctgctcaacgacatcattcactacggaggcgacgtgaacagggctcgccgggacgggaccaccgccctgcaccgcgccgtctgcgacggcaacgtccagatggccgagctcttgctggaacacggagccgacatcgacaagcaggacggcaacggctggaccccgagagccctcgccgagcagcagggccacgacgacatccagctcctgttccggtcgcgcaaggcggcgacggcgagtggccaccatcacgtcccaagctccaccaccaccagggtggcgccggcggcggcggcggcatcactgatcgggaggttcaacagcgagcccatgatgaagaacatgatccacgaagacgccgacctgcccagccgggttctccccgagaagctccggaggaagcgggtcaccttccagaactccctcttcggggtcatctcgtcgtcgcaggcgcagcgggagaccgaccacccgctctcgaggggtggcctcgcggcgacgggctccccgaacccgagcagcggcagccgcaacgccgtcatcagggtgacgatcagctgccccgagaaagggaacaccgccgggaagctcgtgctcctgcctcagacgctggacatgctcctcgagctcggcgccaagaagttcgacttcgcgccaaccaaggttctcaccgtggagggcgccgaggttgacgaggtggagctcatcagagacggcgatcatcttgtgctcgtcagtaatgaatgggatgcagagaagatgaaaggcaagagctagtaaaggagttgtgtgtttttttttctttttcttttttggttgtttactgttgatttccaagaaaggggagatagaatttaccccggagtccaacggttagctaaggaataactggaaatcattggtatagttattccaccatgaagagatggtgaaattgatgggttacgtccggtgttcgtaagtagagaagcgtaagaatttgattttgttatagcgtgttgtgatgttagcctgtttttgttttagttggcaagttgatctgctggcatgtacagttttacgcttttctaatttttgaaggaaaagtccaaagaatgtaccagtgcttc

SEQ ID NO: 1822 - DNA, 1580 bp, Oryza sativa
  Predicted polypeptide sequence is orthologous to G1950
ccgccccccgcgcttcttccccagttctcatcgagggttttcctctctctctctcgcatcgcatccatcccctcgtgtcgccgccggcggaggctgcggcgagccttcaccccccacccgcccaccgccggcgagccacggcgtgggcgacctcctctcctctcccgatcccctctcgcccttaggtaggggcttctccccagtccccaccacacgcgcgtgcgtggccgacgagcaccccaggttcggatcggatggaagaccagaagaaaaatgcaaaaccagaggggtcttctggctcgcaaaggggagctcccccggcacctgatgcaggccttcccaatccttttgatttttctcagtttagcaacttgctcaatgatccatctataaaggagatggcagagcagattgcaagcgaccctgtgttcacccagatggcagagcagctgcagaagagtgctcatgtgaccggggaacagggtggccctgcattggatcctcagcagtacatggaaacaatgacacaagtcatgcaaaaccctcaattcatgtcaatggcagaacgtcttgggaatactcttatgcaggatcctggaatgtccagtatgctcgagagtttgactagtccttctcataaggagctgcttgaagagcggatgtcccgtattaaagaagatccctctttgaaggggattcttgatgagatagagagtggtggtccatctgctatggtgaagtactggaatgaccctgaagttcttcaaaagattggtcaggctatgtcaattaattttccaggagatgctgctacttccactacattgtctggacctgaagaaactgaagaggatggtggagatgatgatgagtccattgtccatcatactgccagtgttggcgatgcggagggtctgaagaaagctttagaggatggagcagacatggatgaagaagacgctgagggaagaagggccttacattttgcgtgtggttacggtgagttgaaatgcgcagagatccttctggaggcaggtgctgctgtaaacgcactggataagaacaagaacaccccactgcattacgctgctggatatggtcggaaagaatgtgtggatcttctgctgaagcatggcgctgctgtcacgccccagaatctggacgggaagacccccatcgaggtggccaagctgaacaaccaggatgaggtcctcaaggtgctcgagatggacgctttcctataaagaaaccaatgccaaatctcacgctcatcatcaccggctcgtcgctttacagttcagatttttactgcatacccaaatcatcatcgactcttttagctttggttttggtgtggtggtggtacattcgttgaatcgttgctatgtttggtgctccgatttgtaatctgtttcacttccccgttacactgcatcactccgtttcatcctttgtattcctatgttgctgagtctggtgttgcagacgttgctcctgtttttctcagcgttttcgtgtcagattggtagtttatatagataagagatgcactgccccggtgtaaaaaaaaaacaaaaaaa

SEQ ID NO: 1823 - DNA, 1140 bp, Oryza sativa
  Predicted polypeptide sequence is orthologous to G1950
ttttttttttttttttttcgaggtgaatggtcttccctccgtttgcctgccaccttcggagtttttttttcttttgtgttttggtgtctttttctccttcgtgtactcaagctggtaatcagttatacttactgctagttcagtaagaaacacagttagtatcacgctcatacagttctgtccacatcccagcttgccatacgagaacaaaggatatataacaaaacgtagagggtgccatcaaattgcattctcgcgtcctacattagtctagtcagcttcttcctcttcctccatgtcatttgcacttattagatgcccaagtgaaactttggcttttttcagttccggtgacctcagtgcagcagcaatgccatcgcttttcctcttctcgccaaaccccgcttcatcttcgtcttttgtagcctcacccgaggacttgtcatcgtcaggcttctcagcaatcgttgacacagaatcatccttcttctccgatggaagctcacctcccttcttcaatgactgctcacattctttcaggaaatcacgaacatcatccttctctgcaacatgtagagccgtctgacccccttttgtctttgcggcgatgtctgcacctttcttgactaaatacttcacaagctccaggtgggagttctgcgaagcaaagtgcaacgcagtgaagcctttcctgttctttgctttcacagaggcaccagatgccagcagctcacggacaacctctacatggcctttctgagaggcaaaatggatcgcagcggtgtcatccatagctgcagctccaacatcagctttgtgcttgcaaaggcacttcacaagctcaacatgtccagcccatgctgccaaatggagtggggtgcgagagaggcgatctctggaattgagggcgagagggttggcctcgcacagagactccgccgccgccaaatctcccgaccgcgcggccttgtgcagatgcaagtcatcctcctcgcctcctccgcggcctcggcctccacggccacgaccgccgccgccgccgccgccgccgccgtgacgcctccccatctctacgctgcagccgctccggatcagagagcctgcagcccgggaattggatcgaaccctcgtgccgaattc

SEQ ID NO: 1824 - DNA, 577 bp, Oryza sativa
  Predicted polypeptide sequence is orthologous to G1950
aaacctactccgcgcacgcgcctctccttctagaaccttctggaaccctcgcccccgcgaaggcggcgccgccgccgagatggcctcctccccctccgccgtcgtcctgcaggccgccctcgacggcgacctccacctcctgtgtgaaatggccaagaagttggacctgcggggattcaaggacatgaatgggcgaaatgcgcttcacttggctgcaagctatgggcatctggagatctgcaagttcctggtggaggaatcgggccttgatgtcaactcaggctctcacagaggtgagacaccaatacttctcgccgcatgtgacggggacattaatgttttaatataccttcttgatcatggtggtgacccagccatacctaacgcggggggcttcacgccgctgcactacgcagcagagtacgggcatgttgatgttgtgagactattgctgtccaaaggagttcatgtggatcctctgaattatagtggggccccgctgcacttggctaccgcaaatgaccatgatcaggttgcgaaggttctgcttgagcatggtgctgatcccaacagagtt

SEQ ID NO: 1825 - DNA, 1122 bp, Oryza sativa
  Predicted polypeptide sequence is orthologous to G1950
agagcaaactgacatgacagttactacaataattcggggctagtatgaattatggcccagttgatcaaatctgattctagatcagaatggttcatacttaaaaaagacaggattcaaccaaaaaaaattagtacaggttttcgataccaaaatttgttccccttcgttaacctttgtgcagcataacattttcagccttcaagcattgccttggctgcatcaattagtgcaggtctaaagctatcagatgctcgaccaagtacggtatagccttccttgtcctcaatggcaacatcagcaccatgtctaactagcagaagagcaaccgctttgtcctcagaaataacagcatgcattagtggtgtttgtcctgttttgtcaactgcatcaacatcagccccctcctcaattaggaattcacacagttcagcatttcctgtactggcagctctatgtaagggtgtgcacccaaacttatctttcttgttgacatttgcactgtgcgctattagtgtttctgctatattaagccgtcctttactggcagcataatgaagagcagtccggccagcatcggttgtcaaatcaacattagcaccttgatcgagcaggatggagatgatctcagcttttccgctgctcgccgccgtgtggatcggcgcccacccctcctcgtccttcccgttcacaacgctggccgccgcgtcgccgcccatcgcggcaagcactctcaccacctgggcgtggccggaggcggcggcgacgtggaggagggaccggccgtcctcatcgcggagggcgagcgcggcggcgaggtcggcgggggagagggaggagaaggccgcggcgtccccggactccgccgcgctgaagagctccttctccgaatgtctcccaccgcccgcggcggcgctggcggcggcgccgtcgatgtccattgtagcagacatcgtgcttaggcaaaagcgaaggcgcagaagagaaatacgcttcgagcctcaggtttgcgtttccctccggccgcggctcatctcgtgcgcgtctcaaatgagccacacacggctctaaagccacgtatcaggatcagaatcagatacggcaatgatacgataagcctcgtgc

SEQ ID NO: 1826 - DNA, 729 bp, Oryza sativa
  Predicted polypeptide sequence is orthologous to G1950
ttcggcacgaggaaaagcaaaagcttcactctctccacaacgacaaggacagagagaaaaaccccaaattccaatcccaaaccctaatccccgctcgccatgccgagggggcgcgtgcccggcggctcgaccgccaacttcagcgcccacctcatcgcggcccagctcgggatgcagtgccgcatgggtcccgcggcggcggagcagatgaggcgcgtcatcgcgtcgtcggactgcgacaccggccgcgtcatgaggatgtttggtgccatggaaggtggcgacagtgattctgattctgatgactctgcggagacggagaaagttgggccactgcatgaggcagcaagcgcagggaaaatggatacttgcaaacatttggtggagcagcttgggtttgacatcaatgctgaagcaagtgatgatttgggtatgacacctttggcttgtgcggtgtccaagggaaaagcaattgctgtgaggtattttcttgacaaaggtgctgatccaaataagcaagacaacatcggttttactcctctgcactatgctacaaaagaagggtatgatggactggcacgactactgctgtctaaaggggctagtgttgatgttatttcttctaaaggcacagccctgcatcttgctgcctccagttggaagtctggcatcatgaagattctattggagcacaatgcagatccaaacaaggtctccgcagattcagag

SEQ ID NO: 1827 - DNA, 806 bp, Oryza sativa
  Predicted polypeptide sequence is orthologous to G1950
gctgcaggaattcggcacgaggggcgacgggacgggaggcttcctcctcctcctcctactcgagactcgacgccgccacctccacctcccgtctcgtctccagaagcttctggaacacccttccggcttcaattcccccctgctcgggtcgggtagctcccttccatcatccatggccgacgccaccgccgccctctcagctcggagcaaggtgcaagctttcctcgaagcggcgcgtgccggtgatctcgactccctcaagaagctcgctgcggcgctcgacgaggagggcaagggcgtcgccgccgtcgctgctgccgtcaaggacgccaacaagcgcaccgccctgcacttcgccgcccgcgagggccgcacccacgtctgtcacttcctcatctccgacctcgccctccccgtcgaccccaaggacgacgatggtgaaactccactcatccatgctacgcgccaagcccatctccaaactgtaacctatctgcttcaccatggagcagatccttccgttgcttcttccctcggagccacgccattgcaccatgctgccggcatagggaacctggaccttatgaaactatttctctccaagggggttgatgttgaatcagaaagcgatgccggcacacccctcatatgggctgctggtcatggacagcaagaggcagtcatacttttgcttcaacacgatgctaagccaaatactgaaaacgatgatggtattacgcctttgttgtctgctgttgcagcgggttccctcccatgcttggatattctaattcaggcaggtgcac

SEQ ID NO: 1828 - DNA, 613 bp, Oryza sativa
  Predicted polypeptide sequence is orthologous to G1950
acagttgtggatgagctattccctaactgtgatgtacttctgcatagcttcttctgtcggcatagcagaagtacatcacagttgtggatgagctattccctaactggagcatgggttcgagcatgaaaaggaaagatgaagataccacagtatctgcttcaagttcgaagggaccaatgggacctgtatttagcagtttaatgtatgaggaggaagatcagggaaatgactctgaacttggcgatatccatgtttcagcaagggaaggagcaattgatgacatagcgaagcatctggctgctggtgtagaagtcaacatgagagatagtgaaggcagaactccactgcattgggctgtcgaccgtggccatctaaattctgttgagattcttgtcaatgcaaatgctgacgtgaatgctcaggacaatgaaggacaaacagcgcttcactatgctgtcctctgtgagcgagaagatattgctgagttgcttgtcaagcatcatgctgatgttcaaatcaaggatgaggatgggaacacggtgcgggagttatgcccttcaagctggtcttatatgaacctggcaaactgacgacacgatgccctctgcactct

SEQ ID NO: 1829 - DNA, 605 bp, Zea mays
  Predicted polypeptide sequence is orthologous to G1950
taaataaacccaacaagggcaacgtaaagttaaaattctagcggggtcaaatctgattctgtagagagccccgttgtttacacaccagaacaagctttaacacctcgactcagcacagtttctcgtatcacactttccatcgtttttgaccagagcaccagatcatccttcgagcattgccttggctgcatcgatgagtgcaggtctgaagctgttcgatgctcggccaagggcagggtagccttccttgtcctcaacatcaacatcagcaccatgtctaattagcagaagagcagcccctttattctcacatataacagcatgcgtaagaggtgtttgtcctgtcctgtcaacagcatcaacttcagcaccttcctcaatgaggaattcacacagctccgcgtttccagtgcttgcagctctatgcaaaggtgtgcagccaaactcgctcaagcaggatgtcgacgatttgagagttgccggagctcgcggcggagtggatcggcgcccacccctcctcgtcctgcgcattcagcacgctagccgcggcgtcaccaccgcactgggcaagcgcgagcaccacctggggatggccggcagcggcg

SEQ ID NO: 1830 - DNA, 849 bp, Zea mays
  Predicted polypeptide sequence is orthologous to G1950
  misc_feature (715)..(715): n is a, c, g, or t
  misc_feature (796)..(796): n is a, c, g, or t
aattcctcactccactcgccccgcccagccagatctttctagaaccttcagcaaccctagggccccagcgagaggcctctgccgccgccatggcccccaaccccgccgcaatcgccctcctggccgccctcgacggcaacctccgtctcctcaagaaaatgtccaaaaagatggatttgcgggtaacaaaggaccctaaagggctgaacgcactccatttcgctgcaaataaggggtccctggagatttgcaagttcctggtggaggacgtgggggtcgatgtcaactcggtatcaagcgtaggtgcgacaccgatgttttacgctgcactcaagggaaatcttcaggttgccaggtatcttctcgatcatggcagcgatccggcgaaacccagtgagaggggcttaacgccgctgcacaatgcagcagagcatgggcattgtgagattgtaaagctgttgctgtccaaaggagttgacgtggatgttatcaattaccgagggacaccattgcacatgactgctgcaaagggtcagcatcaggccatggaaattctgctggagcatggtgctgatcccaacagagtagtcaatcatatcttctcaccactaatgatggcatgctgtgggaactccttggaatgcatgaagctactgattgaggctggtgctgatgtgaatggtaatagtagctctggaccaactcctttaacggngggcagttgatgatggctcaactgaattcgtcaagttcttgctgggagctggagctgaccctaacattcctaacagcacgnggatattccaatcaagagagcagcagtccgtggtcagcgtgaacttgttgagc

SEQ ID NO: 1831 - DNA, 1748 bp, Zea mays
  Predicted polypeptide sequence is orthologous to G1950
ttgggaccctcgaggccggccgggccactcttcttctgccttcccgactctacctgacttcgcccgctctgagaaattcactctcaccaccaccgcgccgcctccactccccccacacccccggtctgaaacccaagcttccgcttctctcatggccgacgccaccgccgccctctcagctcggagcaaggtgcaggctttcctggaggctgcgcgcgccggcgacctccaatccctcaagaacctcgtcgcggcgctcgacgaggacggcacgggcgccgcctccgtcgccgccgccgtgcgtgacgccaacaagcgcaccgccctccacttcgcggcgatcggatgtcgcaccgacgtctgtgaattcctcatcggcgagctcggcctccctgtcgacccaaaggacgatgatggcgaaactccgctcatccatgcgacacgccagggccatctggacactgtcaagtatcttctcgaccatggagctgatccttcgctggccaccagcctaggagccacagcgctacaccatgctgcaggcatagggaacacggaactcatgaagcttctcctctccaagggagttgacgtcgagtcagaaagtgatgctggcactccccttgtgtgggctgctggtcatggcaaccaggatgctgtcaaacttctgcttcaacacaatgctaagccaaatactgaaaacgatgatggtgtcacagcattgttatctgctgttgctgcaggttccctcccatgcttggaggtcctaattgaggctggtgcaaacccaaatgtcaaggctggtggagcaaccccattgcatattgctgcagatagtggaaatatagaagtcatcaaatgtttgcttaaagctggagctgacccaaatacctgtgatgatgatgaattgaagccagttcaggttgctgcttggagaaataaccatgaagctgttgaacttcttttaccgttaacatccccaattccaggtgtttcaaactggaacgtagatgggattatagaacacatgctccctaaagagtatgaggaaaagtctcaactgaaggaagcgacatctctgaaatcaggcctaacacaaactattgaggtgtcatctgaagcaaaaaagaggtccttggaagccaaatcaagaggtgatgatgccttcagaagaaaggactaccttgtagcggtggatgcttatacgcaggctacagagttggacccaactgatgcaacagtgctctcaaacagaagcctgtgctggctgcgggcagggcaagctgagcgtgctctggaggacgccaaagcatgccgtgcattgagaccagattgggcgaaagcctgctacagggaaggtgcggcgcatcgtctgttacagaggtttgaggaagccgcaaacgccttctatgagggggtgcagcttgagccggagaacacggagctcgtcaacgcattcagggaggccatcgaagccgggaggaagttccatggcgtcaacacgccaaactcaacacaatgagactttgctgtttggttggataggtagatgatgaagcggatggacatgaacgttgtcttagttggaagttggtgagatgatgaatgagatgataatgaaatttgaaagagcgaatttgcagatttattttgtgttttgtgattgttttcttaaacttgttttcttgcgtaaaaaaaaaaaaaaaaaaaaaaaaaaaaaaaaaaaaaaaaaaaaaaaaaaaaaaaag

SEQ ID NO: 1832 - DNA, 2386 bp, Zea mays
  Predicted polypeptide sequence is orthologous to G1950
ccacgcgtccgacatccttgagcatggagcagacataaatgctgtggatcacactggacaaacagcacttcactggagtgctgtacgtggtcatattcaagttgctgaactacttctgaaagaaggagctaaggtggatgctactgatttatacgggtatcaggccacgcatgttgcagcacagtatggtcagactgcattcatttaccacattgttgcaaaatggaatgctgatccagatatccctgataatgatggaaggagccctttacactgggctgcttataagggatttgcagactccatacggcttcttttgtttttggatgcttataggggacggcaagacaaagaaggttgtactccattacattgggctgctattcgggggaatcttgaggcatgcactgtcttagttcaggttggcaaaaaggatgatttgatggtgaaagacaaaactggcttaactccagcacagcttgctgccgataagaatcatcggcaagttgcatttttcctcgacaatgctagaagggtacacggcacaggatgtggtgcgaacaccagatttgggaaattgtcaaaattagggctcgctcctcttctttggtgcaccattattggcatgcttattacatacacacactctgttatatcaggacaatatgccatgactacgacagcaccatttgggatattcgcatggtcaggagtttttcttgcaactgctggcttggtcatgttctataaatgtagcaggaaagatccaggttacatcaacataaatgcaaggggctcgcaaaatcaaagggatgatgaaccgttgctgaagatggagttagaaaatcctgcacttctttctggcaactggtcacaactttgtataacctgcaaaatagtcagacctgttcgttcaaaacattgttctacatgtgatcgctgcgtggagcagtttgaccaccactgcccttgggtatctaattgcataggaaagaagaacaaatgggaattcttcatgttcctcactctagaagtttttgcaatgatcattactggctctgctgccattataagaattgtaagagatccaaattctccatcatcctttggtgcttggattcattattctgcgtttcagcaacctggggtggtttcatttctcgcattggattgttttcttttttttggtgttgcagttcttacagttgttcaagcatcacagatagcaaggaacattacaacaaatgagatggcaaactccatgagatatgcatacctcagaggcccaggtggcagattcaggaatccgtatgatcatgggattcgcaagaactgctctgacttcttgttaaatggatacaatgaggacactgaacggctagagcagacattgcccactgatgaggaaatgggaatgatacagatgacaagtgcagtttcgcagcagaacggtgtcaatcatttacatcatggtaatggcactgaccatagttgcgctgtttcacaagcaaactcaaaacctcatagccaagtgggttcgtctcagtgttgtgaccacagtaagaggactgataggacaccgttgggcctaggattgggccttggacgaaacagtgcgtcccggcagtatgttcggtctcttatcccattgtgatccatcatttggcgatcatgtgtttgtttgactgtagattggatttgttcacttattctgttatacgtgctcttgacatggttcaccatggctgggcagggttaacgttgttgtgccatgagctccggaatactaagatatatctggtgttgtagtttagcgttgaactcagagaagttgaaggtaacgacctggtttgcgagtatcagctgatcagcagtctggaatcagagagcttgtgcagaaaatgtaagagttatggactcatggcagatgcagtagcatgagatgtcttcagaattgttgtgtacatcaggttctgtggtacccctattgtttagcgtgatacgagtttgggaaaaaaaaagtagtcgtaaattgagaaaattgtaaattgattagtaagctcactgcaacactagctgttttcctagttttcattcatttttgggtctggttattgttatgaaccacggaaagaattttcggttttcgggtatgggtacctcagttatatttggtctggttatggtacttactggtggtgcatgtttgtgtgagtgcttagagtttaggctatggccatcagatcatgtatatgactatatgactgtgtaaaacactgttttttatctgattgtgtaaaacagtgtttttgtatcgtacactattgttttatagattgaagtttaaaaaaaaaaaaaaaaaaaaaaaaaaaaaaaaaaaaaaaag

SEQ ID NO: 1833 - DNA, 3136 bp, Zea mays
  Predicted polypeptide sequence is orthologous to G1950
aattcggcacgaggttgaactctcctccctcgcccgcgcgtctccgccgccccaccggccaccgcccgcgcctccgccgcggcagctgtccaaaagctgaaaatagatagaatcacgagggggggattgcctagacaacgatccttagttaatcaaacacgggctgccagattcgggggggcgttcgcgttcctaccctctcatcactctccccgtaaaaccccggctgggtttatctcatcgccgccgggcggcgagcggtgggaggcaatggcagggtgggggccctccaggctgccgacgtgcgggccgtggggccgcggcgtggcgctggagagggagctgtcgcgggacggcagccactacagcatctccagcggcatcctgccgtcgctcggcgcgcgcagcaaccgccgcgccaagctcaggcccttcatcgtctcgccctacgaccgccgatacagatgctgggagacttttctcataattcttgtgatatactctgcatgggtttccccatttgagtttggcttcattcggaaaccggcgggcgccctagctgcagtggacaatgtcgtgaatgcgttcttcgcagtggacatcatcctgaccttctttgtagcttacttggatagaatgacatacttgcttgaagatgatccaaaaaggatagcttggcggtatactaccagttggtttgttcttgacgtggcctccaccatcccgagtgttttttgctcggaagatactgccaccagacctcaggtcatatggatttttcaacatgcttcggctatggcgtctccgtagagtcagctctctctttgctagattggagaaagatagacatttcaattacttctgggttcgatgcgcaaagctcatatgtgtcacactttttgccgtccactgttcggcatgcttctactatcttctcgctgacaggtatcctgccccaacggatacgtggattggcaattcgatgccggattttcatcagcggggtttgtggattcgctatgtagtgtcagtgtattggtcaatcactacgcttaccactgtgggttatggtgatttgcacgccggagaacaccagggagatgatattcaacattttctacatgctattcaaccttggattgactgcctatttgattggtaacatgaccaatctggttgtccatggcaccagccgtactcgaaaatatagagatacaattcaggcagcgaccagctttgcactaaggaaccagttaccaagtcggctccaagatcagatgatgtcacatctttgcttgaagttcaggacagattcagaaggtcttcaacaacaagaaacgctcgatgtcctccctaaggctataagatccagcatttctcagtatctattttccgcccgggtccaaaaggtttacttgtttgaaggggtgtccaatgacctcatttttcaactggtttctgagatgaaagctgaatattttccacctagggaagacgtgattctgcagaatgaagcacccacagacttctatattttagttaccggtagcgcggagttgatagagttgcgaaatggcggggaacagatggctggagtggctaaggcaggagatgttgtcggagaaattggggttctttgctataggccccaactattcacagttcgaacaaaatcattatgccagcttctgcgtatgaatcgcactgcctttctcagccttgttcaatccaatgttgcagatggaacaataataatgaacaaccttatgcagttactaaaacagcagaaagacaacagtgtaatggtgggtgttcttaaggagattgagaacatgctagcgcggggtcgtctggacttgccaattaccctctgttttgcggtaaataaaggagacgattttatgttacatcaacttctgaagcgtggtttggatccgaatgaatcagataacaatgggcatacagcactgcatatagctgcttccaaaggagacgaacaatgtgtcaagcttcttctagactacggagctgatccaaatgctagagactctgaaggaaaagtgcctctatgggaggcattatgtgaaaagcataatgcagtgatagagctattagtagagagtggtgcagagctatcatctggagacacggccttgtatgcttgcatcgctgttgaggaaaatgatgctgagctgcttgagaacgttatccgttacggcggcaacgtaaacagcccaacgaaagacggaaccacgccgctgcaccgcgcggtctgtgacgggaacgtccagatggttgagttgttgctggaacacggagctgacgtcgacaagcaggacagtaatggctggtcgccaagagatctagctgatcagcaaggccatgatgacattcaggctctcttcaaatcacgaaaagcacacaggaagcatgcctcaaatggcagagtggcacctatgctgatagggagattcaacagtgagccctcgatgccagatatgagccatgaaaacgccagagtacgcagcgaagttgttccgcagaagctcctccgaaagagggtgagtttccagaattctcttttcggcgtcatctcttcgtcccacgcccaccaggacaccggccgtctgctctcgaaaggcctcgctggaacagagggtccaaattgccgtcacgactccctcatcagggtgacaatcagctgccccgagaagggggggaacgccgcagggaagctcgtgcgcctaccgcggtcgatggccgagcttctcgaactaggtgcaaagaagttcggcatcaagcctggcaaggtcctgacagttgggggtgctgagattgatgaggtggagcttatcagagacggtgatcatattcttctcgtcagtgatgaatgggtgccagatgttgagcaaattaggccttaacaataagtgagccagctgtggtgctcttattgcaatttgacatgatatggggaaacatgcccctgtgaccctgtgtgcatcagtgcatgtcccccatttaaactgaagtgtagcttatgatggttttgaagctgtaggatgtatccagcttggaaatgaatttgtagtcacaaaaaaaaaaaaaaaaaaaaaaaaactcgagggggggcccg

SEQ ID NO: 1834 - DNA, 1037 bp, Zea mays
  Predicted polypeptide sequence is orthologous to G1950
ctttttttttttttttttttttttttttttttttttttttttaccaaacaagcccttagaattttcattcatgcaacacatgagaactgacattcaactttgtacttgtctttacattcaagatcgccgtacagactaagactagcataacaaaacacacaggtgcaggtggaagtggaaccatctaagtgcacttctattgcatcctcaaggtcaaggctgctcgaaatcactcctcttcctcgtccatgtcattttcacaaactagatgaccaagagaaactttggctttttttactcctgacaaactcgacgcaccaaccaattcgcttttcctcttctcgccctgctctgcatcctcctcatctttcataacctcacctgaagacttgctatcgccctctttctcggcagaatcatccttctccgatggtagctcggcacccttcttcaaggattgctcgcactccttcaggaacgcacgcacttcatcatcctcagcgacatgtagagctgtctggccacctttggtctttgctgtgacgtcaacacctttcttcacaaggtacttcacaagatccaggtgagaattctgagcagcaaagtgcagcgccgtgaagcctttccggttcttggctttcacagaggccccagatgccagcagctcacgggccacttctacatggcctttctgggaagcaaaatgaagtgctgcagtgtcgtccattgctgcagctcccacatcagctttgtgcttgcaaaggcatctcacaacatcaacatgcccagcccatgcagccaggtggagtggtgtgcgtgagaggcgatcccttgaattgacggcgagagggttggactcgcacaccgactccactgctgccgcatcaccagaccttgcggccttgtgcagaggaagatcttcttcctcatctcgcccacgccctcgccctcttcctcttccgccgccgccgccgccgctgtgacgccgtcccatcagtctcgccaatcggttaggtaattcccggccggcccccggg

SEQ ID NO: 1835 - DNA, 635 bp, Zea mays
  Predicted polypeptide sequence is orthologous to G1950
cctcgagtacgagtaactccggagtccggatggctgcagcgatggacgtcgacgaagccggcggcgaggagaggcgaccgtcagagaaggagctcttccgcgccgctgagtccggcgacgccgccgcgttcgcctccctcgcccccgccgacctctccctgcgcaacgaggacggccgctccctcctccacgtcgccgccgctgccgggcatccccaggtggtgctcgcgcttgcccagtgcggtggtgacgccgcggctagcgtgctgaatgcgcaggacgaggaggggtgggcgccgatccactccgccgcgagctccggcaactctcaaatcgtcgacatcctgcttgagcgaggtgctgatgttaacctggttactgatggtggtcgaactgctcttcattatgctgcgagtaaagggaggcttaacatagctgaaaaactaatagcccatggtgctaatgtcaacaagaaagacaagtttggctgcacacctttgcatagagctgcaagcactggaaacgcggagctgtaaaaataaaagcgtgcgtctgtattggtcagctcctacagtcttcagacagaagtgctagaccaaggattgatttttgaaccatcgtagaatagtttcgtt

SEQ ID NO: 1836 - DNA, 721 bp, Zea mays
  Predicted polypeptide sequence is orthologous to G1950
  misc_feature (672)..(672): n is a, c, g, or t
gaggctcggccgggtaatagcccatggtgctaatgtaacaagaaagacaagtttggctgcacacctttgcatagagctgcaagcactggaaacgcggagctgtgtgaattcctcattgaggaaggtgctgaagttgatgctgttgacaagacaggacaaacacctcttacgcatgctgttatatgtgagaacaaaggggttgctcttctgctaattagacatggtgctgatgttgatgtcgaggacaaggaaggctacactgcccttggccgagcatcgaacagcttcagacctgcactcatcgatgcagccaaggcaatgctcgaaggatgatctggtgctctgctcaaagacgatggaaagtgtggtacgagaaaccgtgctgagtcgaggtgttaaagcttgttctggtgtgtaaacaacggggctctctacagaatcagatttgaccccgctagaattttaactttacgttgcccttgttgggtttatttaaccattgtggagtggagacgaataatcaacgtgccgtgacatcggatgacacaggccaacttttctaaaaaaaaaaaaaaaaaaaaaaaatttgccgcctcggaagcactagctgctcaggccacacaggagaacttcgacaagggatcaatcttcccgcccttcactaacattagnaaagatctctgcgcgcattgccgccagccgtggctgcaaaggcttatga

SEQ ID NO: 1837 - DNA, 1148 bp, Zea mays
  Predicted polypeptide sequence is orthologous to G1950
ccggccggggaaagcgcaatcaactctagtctctagccacaactcgaagtacgagtacctccggagtccggatggctgcagcgatggacgtcgacgaagccggcggcgaggagaggcgaccgtcagagaaggagctcttccgcgccgctgagtccggcgacgccgccgcgttcgcctccctcgcccccgccgacctctccctgcgcaacgaggacggccgctccctcctccacgtcgccgccgctgccgggcatccccaggtggtgctcgcgcttgcccagtgcggtggtgacgccgcggctagcgtgctgaatgcgcaggacgaggaggggtgggcgccgatccactccgccgcgagctccggcaactctcaaatcgtcgacatcctgcttgagcgaggtgctgatgttaacctggttactgatggtggtcgaactgctcttcattatgctgcgagtaaagggaggcttaacatagctgaaaaactaatagcccatggtgctaatgtcaacaagaaagacaagtttggctgcacacctttgcatagagctgcaagcactggaaacgcggagctgtgtgaattcctcattgaggaaggtgctgaagttgatgctgttgacaggacaggacaaacacctcttacgcatgctgttatatgtgagaacaaaggggctgctcttctgctaattagacatggtgctgatgttgatgtcgaggacaaggaaggctacactgcccttggccgagcatcgaacagcttcagacctgcactggatcgatgcagccaaggcaatgctcgaaggatgatctggtgctctgctcaaagacgatggaaagtgtgatacgagaaactgtgctgagtcgaggtgttaaagcttgttctggtgtgtaaacaaaggggctctacagaatcagatttgaccctgctagaattttgcccttgttgggtttatttaaccattgtgactaacatctcataagctaagctttggttctcccttctctctttcttttatgtctgttcatgatggcgtatcaggctatcagctaacagatcggtgactgtcacacccggctttaaggaacaaagccaggtgcatctcatacatctcatctttttgaattcaaacttgaatttggatttggtt

SEQ ID NO: 1838 - protein, 943 aa, Oryza sativa
  Orthologous to G1950
MARWGAARMAACGPWGRNRRVGAGDAFEASEVRRDGRSRMMPACGPWGAGHGGGDPALERELSRDGSHYSISSAILPSLGARSNRRIKLRRFIISPYDRRYRIWETFLIVLVVYSAWVSPFEFGFIPKPTGALATADNVVNAFFAVDIILTFFVAYLDKMSYMLEDDPKKIAWRYSTTWLVLDVASTIPSEFARRILPSKLRSYGFFNMLRLWRLRRVSSLFSRLEKDRHFNYFWVRCAKLICVTLFAVHCAACFYYLLADRYPVPTSTWIGNYMADFHERSLWIRYVTSVYWSITTLTTVGYGDLHAENTREMIFNIFYMLFNLGLTAYLIGNMTNLVVHGTSRTRNYRDTIQAATSFGVRNQLPPRLQDQMISHISLKYRTDSEGLQQQEILDSLPKAIKSSISQYLFFHLVQNVYLFQGVSNDLIFQLLRTVTEYAYLVLLLDFVFEVSEMKAEYFPPREDVILQNEAPTDFYILVSGSVVIQVATSGEVVGEIGVLCYRPQLFTVRTRSLCQLLRLNRTAFLSIVQSNVGDGTIIMNNLIQFLKEQKENSVMAGVVKEIESMLARGNLDLPITLCFAVTRGDDFLLHQLLKRGMDPNESDNDGHTALHIAASKGNEQCVRLLLEYGADPNARDSEGKVPLWEALCEKHAAVVQLLVEGGADLSSGDTGLYACIAVEESDTELLNDIIHYGGDVNRARRDGTTALHRAVCDGNVQMAELLLEHGADIDKQDGNGWTPRALAEQQGHDDIQLLFRSRKAATASGHHHVPSSTTTRVAPAAAAASLIGRFNSEPMMKNMIHEDADLPSRVLPEKLRRKRVTFQNSLFGVISSSQAQRETDHPLSRGGLAATGSPNPSSGSRNAVIRVTISCPEKGNTAGKLVLLPQTLDMLLELGAKKFDFAPTKVLTVEGAEVDEVELIRDGDHLVLVSNEWDAEKMKGKS

SEQ ID NO: 1839 - protein, 329 aa, Oryza sativa
  Orthologous to G1950
MEDQKKNAKPEGSSGSQRGAPPAPDAGLPNPFDFSQFSNLLNDPSIKEMAEQIASDPVFTQMAEQLQKSAHVTGEQGGPALDPQQYMETMTQVMQNPQFMSMAERLGNTLMQDPGMSSMLESLTSPSHKELLEERMSRIKEDPSLKGILDEIESGGPSAMVKYWNDPEVLQKIGQAMSINFPGDAATSTTLSGPEETEEDGGDDDESIVHHTASVGDAEGLKKALEDGADMDEEDAEGRRALHFACGYGELKCAEILLEAGAAVNALDKNKNTPLHYAAGYGRKECVDLLLKHGAAVTPQNLDGKTPIEVAKLNNQDEVLKVLEMDAFL

SEQ ID NO: 1840 - protein, 336 aa, Oryza sativa
  Orthologous to G1950
MGGDWQELAQAAVIGLLFAFLVAKLISTVIAFKEDNLRITRSTPTFPSAADTPAAPAPPPASLDGGHGDTSDGSGSDSDSDWEGVESTELDEDFSAASAFVAASAASGTSVPEQAQLQLYGLYKIATEGPCTAPQPSALKLKARAKWNAWHKLGAMPTEEAMQKYITVVDELFPNWSMGSSTKRKDEDTTVSASSSKGPMGPVFSSLMYEEEDQGNDSELGDIHVSAREGAIDDIAKHLAAGVEVNMRDSEGRTPLHWAVDRGHLNSVEILVNANADVNAQDNEGQTALHYAVLCEREDIAELLVKHHADVQIKDEDGNTVRELCPSSWSFMNLAN

SEQ ID NO: 1841 - protein, 174 aa, Oryza sativa
  Orthologous to G1950
MGGDAAASVVNGKDEEGWAPIHTAASSGKAEIISILLDQGANVDLTTDAGRTALHYAASKGRLNIAETLIAHSANVNKKDKFGCTPLHRAASTGNAELCEFLIEEGADVDAVDKTGQTPLMHAVISEDKAVALLLVRHGADVAIEDKEGYTVLGRASDSFRPALIDAAKAMLEG

SEQ ID NO: 1842 - protein, 2278 aa, Oryza sativa
  Orthologous to G1950
MADPSFNFRVGLALRRALPYYNDAGPQSEFFEAATRGNVRRLRELASGKDAEGKAWLADMGFSGIGPLQAAARLGEVESCRCMVEELGFDINAGSQLGHDEVARLLLSRGASIDIAYFHGTPLHIAAAYGKADVMKVLLEHHADPNKVSEELGTPLVATLHATSQGLAESISLKCVKLLVEAGADVNFSDRDTPLVDKQDDQNEKAQLKLCGEKAVKRKDYRGASNFYSQFQNIELAIEMDPTDATLYSNRSLCHLQMTEAEAALFDAEFCIQLRPEWIKGYYRKGAALMLLKKHEKACDAFMAGLKLEPGNAEMEKALRYDRLVNTSYTVVLPLLSSSLCETLASQQTPPLRGGKGDPRENELLNAVTEGNARRLKKMVNTMGEKDRAKFTDMNIDGNGLLQVAAHLGKIEVIRYFVEELGFDVNAGCLSDGVTALASAAMFGEAYVVRYLLEHGADPNKTDETGSVALHFAAKNGYEEVVRLLLSSGARTGIVVAHGTPLHIAVFYRRIGVVKILLDHHVDSNNTSGVWGTPILTALRSAKHGLDESDSLECVKLLVKAGADVNYACPNTPLVVATTAGLTDCIKYLLEVHADPNIPDKQSGRTPVEISASVGRRDHVEILFPFTSSISAVTNWTVEGIIAHGKSRRLTPKIVDLDSKFEIVPNMGMSRYIVKIPYFGMELAALGYAEAARTAEAARQAAAAAATLRAEEERRDLELANAACVRRDADRDRHVGRRDRDFSPHCGGSDLHRDEEWHDLWRDPWIDRALEAQRLWEQAAAIEAQLDFDREQGGRDIGARSPRRQRASPSSDRHRGRRGRSGSPPVVQTIVKDVGGAWPMLTKTNYAEWAMVMKVKLQARHMWDTVWYGDVDYGEDRRALEALLAAVPTEMQSSIVNKRTTKDAWDAIASARIGSDRARRSTLQKLRQDWENLAFKPGEDIDDFVLRLNSLQQRLAQLGDTTIDEERAVEKLLRVVPEKYTQLALSIETLLDFTELTIEEVMGRLKAVDNRKQLPPSEPITIGGKLFFTKEQWLARQQEWKKGEATGSSASGSSSSRKRRPRKWEKARSGALGDANGEHKGSRDDTCHNCGKTGYWAKDCRQAKHGGQAHVAQAQEAAAHVFLSNGSCGDKIDGWCLDTGATHHMTGRREFFSELDSSVQGSVKFGDASTVVIKGVGSILFTAKTGEHRLLTGVYYIPALRNSIISLGQLDENGSRVEIEDGVLRVWDRHRRLLVKVAQPVCLAARRDDDAWRWHERFGHLNFGALKQLGNKEMVQGMPRVEHVEQFCDTCVLTKQRRLPFPRQASFRAEEKLELVHGDLCGPVTPATPGGRRFFLLLVDDVSRYMWVVLHDSKAAAADAIKHHQVAAEKECGRKLRVLRTNNGGEFTAAEFAAYCADEGIQRHFSAPYTPQQNGVVERRNQTVVATARALLKQRGMPAIYWEEAVMTAVHLLNRLPTKALDGKTPYEAWHGRKPVVSHLRVFGCLAFAKELNHVGKLDDRSSPGVFIGYAEGVKAYRILDPATQRVRISRDVVFDEGRGWAWDKAVDDGSTSTLRDFVVDYVHFGGAGGASSSSSPSSSTSAPGSPSAPASPPPPTPPATPPSPATPCSPTPAPTPPVEFATPLSNDEDRVDAYHDDEPLRYHTVDNIFGDQPVLGLATHDFEAELHLAHEDGEPCSFAEANGDVAWRTAMQHEMDAVERNRTWVLADLPVGHRAITLKWVYKLKKDEAGAVIKHKARLVARGFVQQEGVDFDDAFAPVARMESVRLLLALAAQEGWRVHHMDVKSAFLNGDLKKEVYAHQPPGFVIPSKENKVLRLRKALYGLWQAPRAWNAKLDSTLKQMGFQQSSHEAAVYRRGKDGNALLVGVYVDDLVITGTKEAEVEAFKEEMKATFQMSDLGLLSFYLGIEVHQDSSGISLRQTAYAKRIVELGGLTGCNLAYTPMEERLKLSRDSTAEEIWHSLLAVSRFMQRPTTEHQQAVKRILRYVEGTTNYGLHYPRCPGAQHFIGYSDSDLAGDSDTSKSTSGMLFFLSKCLISWQSVKQQVVALSSCEAEYIATTTASTQALWLVRLLGDLLGRDAEAVELRVDSKSALALAKNPVFHERSKHIRIKYHFIRSCLEERSIKASYINTQDQLVDLLTKSLGRVKFQEFRARIGMDESCGKVNDRKAELKSHGEKAVKRNDYLAASKIYSEALELDYFDATLYSNRSLCNLQIGEAQKALLDADRCVELRPKWVKGHYREGAALMVLKEHKKAFEAFLNALKLDPANAEIEKVMW

SEQ ID NO: 1843 - protein, 472 aa, Oryza sativa
  Orthologous to G1950
MPRGRVPGGSTANFSTHLIAAQLGMQCRMGPAAAEQMRRVIASSDCDTGRVMRMFGAMEGGDSDSDSDDSAETEKVGPLHEAASAGKMDTCKHLVEQLGFDINAEASDDLGMTPLACAVSKGKAIAVRYFLDKGADPNKQDNIGFTPLHYATKEGYDGLARLLLSKGASVDVISSKGTALHLAASSWKSGIMKILLEHNADPNKVSADSETPLAATLIASDGLNEPAVLKCIKLLVKAGANLNRAIPDTPLVIATNKDFVECVEYLLEAGANANIPTNNGGKTPIEIAAKSGRRKLVEILFPCTLPIKGVSNWTVEGIITHVKSKKSKKKACAQDKESGTDKKAQLKSLGASAVQGKDYVGASKFYSEAIQLDPTDATLHSNRSFCYLKSGEAREALVDAKTCIGLKPDWPKGYYRKGAALMSLKEYKEACDAFMDGVKLDPASGEMHEAFWEAAAALKKKHLAGKTVSSFD

SEQ ID NO: 1844 - protein, 485 aa, Oryza sativa
  Orthologous to G1950
MEKKDKGRHRGRDGGGGGGGGGGGGGGGVDPAGGGSGGGGPGMGRRGSDARGQQAEAAAAAISGIATRLGFGCTINVGGGMPPQMEFLMACTDGDVARLKEVVDSMDEDDRQSLTSVRMEGYEPLFEAASSGKIDLCKYLVEELGFDVNAEANHDSGMTPLFCAVLDGQEITVKYFLDKGADPNKKDAAGFAPLHEAAKKGHVGIARLLLSKGASVDVSSSEGTPLHVAASNGKSSTVQILLEHRANIQRSQVDAKSFRNRVQVFYVPALPNVILPDCYTPLTAVLSATPEIVNESECLKCMKLLVKAGAIYNLATPDTPLKIATRNGLTECVAYLLEITTVKLSEHDKGSDGDRKSKLKLHGGKAFEEGDYAGAIIFYTEAMKLDPADATLYSNRSLCHLRSGAAQEALLDANDCIKLKPEWTKGHYRKGCAHMALKEYEEACTAFMAGTKLNPLNDEMQDAFWEAAKGMMYEHMAGKRVSSVD

SEQ ID NO: 1845 - protein, 910 aa, Oryza sativa
  Orthologous to G1950
MALLAVALLAAALHADAAPASAAPGSSFPDAYGDRARAAQLPPRKQQPQVAYALRRASATSSAHLHGATSRSFTGVATEGCEQIRVFLGIGCCDEVKARYSRYETIVKLASSIGTVVPVALSIVPYFYQVYTGNFERTIEVYGAPAMLAGSINSIIWLTYSIMASKKDLNLALILMHALLCMSTFTYLMCICACKRATKEGYILGAFFIGCLSAISIVVHWDLNPSKVVKIIFRCFGGISLLSCHYILLNDILGSVPKRSQKVATGFDLILSCITNLVTFIITFHDHPEHTTSLITSGVGFVLNVVEIVLLVIVTIMGYFFPLSEHPDADVEASRHISATRGMIPLEDALGTPETDDFIAVLTHEPQVPQFEVSYLILQVRNEFEIYSLRSMVNPNVQIITREVIQRTMMRIERDHYIQILLQASGIAGQEPDASPSIRGRKRGGSVPLLVYYRCAAVLDVDTARAQAGETPLLLAATFGHTSTAAYLLDRGADPSTPDPNGGDTPLHWAAYNGDRELAKLLLLRGADVGAANPRGTALHVAAARGHAAVVSVLLNHGADPNKIANIVFTPLVSSLLGGSLECMKLLIQAGANVNGAGFNGATPLLLACSRTGSIGFIKCLVESGADPNIPDELDRLPIEIAAIHAEREVIEVLLPLTHQVPTLLDWSVGGIIRYVKYPAYKEWARNASCKRKDELKLQGNSSFNNEDYDAAILLYSMAMKFDNTDAKLYSNRSACWLNLGIGDEALSDAQICSKMQPDWAKGYYRQGMAFSLLQDYASASYVLRRALKLDPQNATVAKALRCYENKIYMTENVLEKRGDVLETACPRMEESGLAFVHQKKRDWSPAAAGRSVPDATFQIDKKILPVWVKIWGVPRRPLLGCGWMYLPPVNNVPESSAPEEQQITVLGSE

SEQ ID NO: 1846 - protein, 336 aa, Oryza sativa
  Orthologous to G1950
MGGDWQELAQAAVIGLLFAFLVAKLISTVIAFKEDNLRITRSTPTSPSAADTPAAPAPPPASLDGGHGDTSDGSGSDSDSDWEGVESTELDEEFSAASAFVAASAASGTSVPEQAQLQLYGLYKIATEGPCTAPQPSALKLKARAKWNAWHKLGAMPTEEAMQKYITVVDELFPNWSMGSSTKRKDEDTTVSASSSKGPMGPVFSSLMYEEEDQGNDSELGDIHVSAREGAIDDIAKHLAAGVEVNMRDSEGRTPLHWAVDRGHLNSVEILVNANADVNAQDNEGQTALHYAVLCEREDIAELLVKHHADVQIKDEDGNTVRELCPSSWSFMNLAN

SEQ ID NO: 1847 - DNA, 527 bp, Glycine max
  Predicted polypeptide sequence is orthologous to G1958
  misc_feature (426)..(426): n is a, c, g, or t
acgcgtccgggagtgggctgagaggctaatcagtgatgatggcacattgacttctaattggaatgaccttcttgctgacaacattcaagatcttgagccaaaggtgaagtttttcataattcaaatcaatattagctttcagaggaaactgattagtaatttatttaagaaatgtgctaggatctcattttattgctttaggggccattccaagtttcaaaaccactttcacagattccaggacatcaatcccaaggtcatcaacaacttcctgcttcatatggagaaaattgcgctggtgctgccctctcttcctcagcaaattctgctcctgctaagtcacgaatgcgttggacaccagaacttcatgaggcgtttgtggaggctgtcaaccaacttggggggagtgaaaaagctactccaaanggtgtgctgaagctcatgaaagttgaaggattaactatatatcatgttaaaagccatttgcagaaatacaggacagctagatatagaccggagtcatctga

SEQ ID NO: 1848 - DNA, 1878 bp, Glycine max
  Predicted polypeptide sequence is orthologous to G1958
caaaagcaagagcctatagttgacggcgttggttggggttctaagattgttttgtttgagttaaacgcgacaaactcaaatacgtgtgcattacaactcctaacccctcaccatcctcttcttctctctcattcatacccctccttttttatttgtattctcagctttgttagattccgtttctggtttttcccaattccatagtactctgttatcgtcgtcatcccttttataggacagacaaagctgattcacttaggagcctcgagagctatgtctacatcttctcgtgttcttcccactccattggaaaacaagtatatgaaacccccagattcttttcagctttcgccagtcagagatctgactgcaaattcagcctcatcaaattcaatcagaagtgctgggaagatgttttcttcaccttctaaatgtcccgatgacttccctttttcctctgtttcacagcatgataggcaatatcaagatcccccctttgtttctcagacaattggtgatagcgtgtcttccgaaatacattcaatgacattcatttctcaccctcaagaaaatgaagatctttcctggggaccagatccatgtcaggatattcttggctttcctgaaaatgtttctgtccagcatgatcaggtggaaaacaatggttgttacataaatgatgataatgtcaaaagatctgattttggggagtgggttgatcagttaatgtcaattgatgattctcttcacccgagctggagtcagcttcttgctgatgacaatgtagcagaaccaaaaccaaaaggcatctcaggttcctccgcagcagcatataccatctggagaagttgttggtaattcagcatcaactgcatcgcagactaaggctagaatgcgttggactccagaacttcacgaggcctttgtggaagcagttaatcaccttggtggtagtgagaaggctactccaaagggtgtgttgaatcaaatgaaagttgaagggcttactatctatcatgtaaaaagccacttgcagaagtatagaactgccagatacaaaccagagccatcagaaggaacgtctgagaaaaaggtgactccaatggaagaaatgaaatctctagacttgaaaacgagtaaggggatcactgaagcattacgtttacagatggaactccagaagcgacttcacgaacaacttgagatccaaagaaagttgcagattcaaattgaagaccaagggaaacgtcttcagatgatgtttgagaaacagagagagatgggtgacagcaaggttaacgtctccttggacgagccttctgctgcagcaccatcagacacagtagaaaccacaaatgaggaacgccacaaatttgaaagcattccaaaagccatacccgaagagaaggagtcaagcacaacaaaacaaattgcaggtgaagctgaagaaatgatcaaggaagatgaagttgcaccacccacaaaacgggtgaaaagttcgtaacagcaggatcgttgttttatgccttctagatttgtttaatattcttagactggtttggactccatggaacttgtagaaatattattggatccaaggatgtttcaacttgctcatttatcacagccatttcctatgaaaatatggcatgagtgccacaagtaatggtggctcattgtgatggaaattttgttaccatcctcttagtggtccttgaggtttttttttttttcttttctttttcacatgtaaactagcatttatttatacctgtgtttaatgtattatatagaaaatcagaattgaaaaataaaagtaatattaagactccaaagaaataatacattttcaaaaaaaaaaaaaaaaagggcggccgc

SEQ ID NO: 1849 - DNA, 2235 bp, Glycine max
  Predicted polypeptide sequence is orthologous to G1958
aacattattacattggggaatgtacatggtacctggtactgcaacaggatcatcaccaatccaatcaccgatagtgagcttcacgcgccaccttggcgcgtagggttgccagctgctattcctccaaccaaaaggagccaaagccaaagcccattcgttcgtcaccgttctgttcactctcgcgagcacccacccaaccttcttcgccttgccggtgatggaattaaaagcacccgccctagtctgcatccaattcttgagcttcacgtgaaccccttctcggattgatgacaacttgtctggtttgggcatcaagaacaaaaaacaagctttgtagaattttactggaaaattatggaagcacgttctgctttctctattgacaggtcaaatgctaagcaactcaatgacatggggatgtctgaagcatttccctcatcgttgcctgcccttccatcgcctctagaagagacattccccaaattatctgattctcgaccagcttttatggaaaaagagcttaaaacaaaaccttttacacattcaagtcatttaacttccagcggagcagttgggcatatgttttcatcttctcctggatattcaactgatcttcatcactcatccttttcatctcatgaaaaacaacctagaaatactcattttatttcacagtcattaagtaacatggcttcattgccattatcttattcttcaaatagtgaaccgataccttctacaacatcaaccccttattccaatggaaacagtgtttcctggcatacagattccttgcctagctttctcgatttccctgccaatacctccattggtaatagtcaagtagaaagcagtgactgcaatatcatggcaactgaagagtattctaagcgaaatgattggcaggagtgggctgaccaattaatcagtgatgttgatcctttgacttctaattggaatgatcttcttgctgacaacattcaagatcttgaaccaaaggtcgcaaaatcatcttctcaacttccaataggacaccaatcccaaagccatcaacaacttcctgcttcatctggagaaaatcgtgttggtgttgccccaacttcctcaacaaattctgcacctgccaagccacggatgcgctggacacctgagcttcatgaggcatttgtggaggctgtcaaccaacttggtgggagtgaaagagctacccctaaaggtgtgctgaagctcatgaaagttgatggattaactatataccatgttaaaagccacctacagaagtacaggacagctagatatagacctgagtcatctgaaggagctgcagagaaaaaactaagtccaattgaagagatgtcatctctagatttgaaaactggtattgagatcacttgaagctctgaggctgcagatggaggttcagaagcggttgcatgaacagcttgagattcaaagaaatctacagttgcgaatagaagaacaaggaaggtaccttcagatgatgtttgagaagcagtgcaaacctggcattgaaacgtgcaaggcaccatcatctgtcatcgagactccatctggggggtcttctgatgccacgaaagattcccctgccaaaactgaaatggaagcatcacaagtgaaccatggcaggtcaggacctgatcaggttaagggcagtacgacatttgaggaaggctcattggaaaagtgcgggaagcctgattctcccaaaactgaacatgctattgctagtgaagatagtgctcaagccccgaagcgtcaaagaactgagtaagccatatgaatctgctgaatcacagtatcaacagtgatactacaagacaatactgaaccatgaaagatttcatttaagaaagattaggctgaatgattggtcgagatcctaacttatgagttcctcctctccaattgtggtcaatgagtacaatgtacatttagcaaaaaggtggtcgcctcagttacttgaaaggctgatgttagttttgccgttagaaatcctccttggtagagagtttgtaaatattagtatcactgtaagccattactaaacttgtgcacactatctatccttagaatgcggaacccccttcctgagctctatactttatgccccagaaaaagaaaataaaaaacaatgagtcaagtcaacgagcttgtagctcaacttgatgataaaaaaaaaaaaaaaaaaaaaaaaaaaaaaaactcgaggggggg

SEQ ID NO: 1850 - DNA, 802 bp, Glycine max
  Predicted polypeptide sequence is orthologous to G1958
tcgagacctctctactaatagctcattctgatttcatcatatcatcaactatacatcatcccaattgtccaattatcatatttcttcgaagatactggaccatccaatcttcagcaacatccaagccattattccaaagaatagcagtgtttcctggcatacatgattccactgccatagctttctagagattttcctgaaaataggctctattgataatatatcgggtagaaagtagtgcctgccctataatggcatctgaggagtattctaagcaaaatgattggcaggagtgggctgagaggctaatcagtgatgatgacactttgactactaattggaatgaccttcttgctgacaacattcaagatcttgagccaaaggtgccgctccaggttcctgatcctcggccacagattccaggacatcgatcccgcggtcatcaacaacttcctgcttcatatggagagaattgcattggtgctgccctctcttcctcagcacatgtttgctcctgctacgtcacgaatgcgttggacaccggaacttcatgaggcgatggagacggctggcaaccgacttggggggagtgaaagagctactccagcgggcgtgctgaagctcatgaaagatgaaggattaactatatataatgttaaaagccattagcggaaatgcaggacagttagatttacaccgtagtcatctgaaggagatatggacaaataaacaagttcctgtgaatagatggcatgtatagatgtgagaactggtattgagatcactgaagctctacgactac

SEQ ID NO: 1851 - DNA, 882 bp, Glycine max
  Predicted polypeptide sequence is orthologous to G1958
aacttattaccattggggaatgtacatggtacctggtactgcaacaggatcatcaccaatccaatcaccgatagtgagcttcacgcgccaccttggcgcgtagggttgccaagctgctattcctccaaccaaaaggagccaaagccaaagcccattcgttcgtcaccgttctgttcactctcgcgagcacccacccaaccttcttcgccttgccggtgatggaattaaaagcacccgcccttatctgcatccaattcttgagcttcacgtgaaccccttttcgggagtgggctgaccaattaatcagtgatgttgatcctttgacttctaactggaatgatcttcttgctgacaacattcaagatctggaaccaaaggtcacaaaatcatcttcacaacttccaatagaacacctcgcgccgcgccagccgcaacttcctgcttcatctggagaaaaatcgtgttggtgttgccccaacttcctcagcaaattctgcacctgccaagccacggatgcgctggacacctgagcttcatgaggcatttgtggaggctgtcaaccaacttggtgggagtgaaagagctacccctaaaggtgtgctgaagctcatgaaagttgatggattaactatataccatgttaaaagccacctacagaagtacaggacagctagatatagacctgagtcatctgaaggagctgcagagaaaaaactaagtccaattgaagagatgtcatctctggatttgaaaactaattatccaaatcttatcacttaactggagaagagaacagatagatggacaaaaagtggtattgagatcactgaagttctgaggctgcagatggaggttcaaaagcggttgcatgaacagcttgag

SEQ ID NO: 1852 - DNA, 2072 bp, Oryza sativa
  Predicted polypeptide sequence is orthologous to G1958
  misc_feature (2054)..(2054): n is a, c, g, or t
gctcgtgtggcccaggggctggctcgtgcgggcgggggtccgcctcgcgaaaggccgcgtgccaccatttctccccacatctcatccctctctctctcctcgcttctctctctttcgcaggcgaaggcgaaggcgaaggattcgggctcagctcctccgcctccgccgatctctcgccggagatgtgtcagccctaggagaggagaagctttctttttttggaaaatcgagtcaacaaaaggtcttgccaattaacacagtgaaggataattctggcttgagtgtttgtaaatggagagaataagcaccaatcagctctacaattctggaattccggtgactgtgccatcgcctctgcctgctataccagctaccctggatgaaaacattcccaggattccagatgggcagaatgttccgcgggagagagaattgagaagcacacctatgccacctcatcagaatcagagtactgttgctcctcttcatgggcattttcagtccagtaccgggtctgttgggcctctgcgttcgtcccaggcgataaggttctcttcagtttcaagcaatgagcaatatacaaatgccaatccttacaattctcaaccgccgagtagtgggagttcttcaacgctcaattatggatcacaatatggaggctttgaaccttccttgactgattttccaagagatgctgggccgacgtggtgtcctgatccagttgatggcttgcttggatatacagatgatgtccctgctgggaacaatttgactgaaaacagttctattgcagctggtgatgaacttgccaagcacagtgaatggtggaatgattttatgaattatgactggaaagatattgataacacagcgttgtactgaaactcaaccacaggttggaccagctgcgcaatcatctgtcgcagttcaccaatcagctgccccacaatcagtttcatctcaatcaggagaaccttctgcagttgctataccctcgccctctggtgcctccaatacctccaactccaagacacgaatgagatggactcctgaacttcatgagcgctttgtagatgctgtcaatctacttggtggcagtgaaaaagctactcccaagggtgtgttaaagctaatgaaggcagacaatttgaccatttatcatgttaaaagtcaccttcagaaatacagaacagctcgatacagaccagaattgtctgaaggttcttcagaaaagaaggcagcctcaaaagaggacataccatcaatagatctgaaaggagggaactttgatctcactgaggcattgcgtctccagttagaactccaaaagaggcttcatgaacagcttgagatccaaagaagtttgcagctgagaattgaggagcaagggaagtgccttcagatgatgctcgagcagcagtgcatacctgggacagacaaggcggtggatgcttcaacctcagcagaaggaacaaagccatcttctgatcttccagaatcttctgccgtgaaggatgttccagagaacagtcagaacggaatagccaaacaaacagaatcaggtgacagataatgaggatgtgatgagggtctctccaagatgtggacccaagtggccattgaatgggctcgatggctatctgactgatgtttggcaaagctaaaattaaatcgtttttgccttttcacggggaacagaacattgttgtgaacagcatatcaaagcttgccccagcgcttgtagctagactttagttgtacagtaccccaaacacggcagcgacgattccgtgttaatgggatgatctttaggtttcagaaggcagcacaagcaaatttgcactgatgtactctttgtcaggtggtttgacttcttgctttctttgttgttagggactggatagcatggattaggaatttgattatgatgaactaattcaagaaattgccataatctttggtaccttgtgcgcctggaacatgtaaatggtaccaaacaacaatatgatatgtttaccttcatgttcaaaaaaaaaaaaaaaaaaaaaaaaaanaactcgagactagttctc

SEQ ID NO: 1853 - DNA, 508 bp, Oryza sativa
  Predicted polypeptide sequence is orthologous to G1958
gcacgagggctccagtctttatgtaataataatacccatgggggacacactgtgccaacgtttttcccagctcctgcctgtggcgcgccagattacatggatactataactgtccctgataatcacacccagagcggctcctctactgttacatctgatgctgctaaacaaaatgaatggtgggcagatataatgaatgatgactggaaagatattctagatgcaacagctactgattctcagtcaaagtccatggcccaaccttccaattctgctgcatcacagcctgctttcaatcagtcaacttcatcccatagtggcgatatttgtcctgtcacaagtcctcctcccaacaacagcaatgcctctgcaagtaaacaacggatgagatggaccccggaattggatgaatcttttgtccatgctgtaaattagcttggtggtagtgaaaaagctactccaaaaggtgtgctcaagcttatgaaagttgatggtttgacaatctatc

SEQ ID NO: 1854 - DNA, 2079 bp, Zea mays
  Predicted polypeptide sequence is orthologous to G1958
cctcgaggccggccggggcctcacatctcattcctctcctctctccgccccccctctcgctcgagctctgttggaggcaggagggcaggccagggcgccaggccaggcgaggtggttcggttgacgagttcttcctcttcctcgacatcgccgatcccgccacgcgctgcccgcagcggaggtgagacacaataatcttagatggagaggttaagcaccaaccagctctacagttctggtgttcctgtaaccgtaccaacatctctgccttgtataccagtctctctggatgagagcttcccgaggcttcccgatgcacagagtgttttgatggagagagaattgaggagcactccactaccacctcaccagacaactgttgctcctatccgtggtctgtttcactccaatactggatctgttggtcctttgtgctcacctccgtctgtaaggttctcttcgcattcaaatcctgagcaataccccaaccacaattcatacaattctcaagtaccaagcactgcaagttcctcaacgctgaattatgggtcacaatatggaggctttgaaccatccataaccgatttcccaagagacattgaaccaacttggtgccccgatccagttgagagcattcttggatactctggtgatgtccctgctgggaataatttgactgggaccacttctattggagcttcagatgatcttactaagcaaactgaatggtggacagagtttatgaatgaggattggaaggacatggttgataacccgacttccacagaaactcaaccggttgggcaacctgtgcaatcatccaactcagttcaccaatcagctacccaacaaacagtttcatctcaatctgttgaaccgttggcagttgtggcaccctcacccactgctggctccaatactggcaaggcacgcatgagatggactcctgagcttcacgagcgctttgtggatgctgtcaatatacttggtggcagtgaaaaagcaactcctaagggtgtcctgaagctaatgaaggcagacaatttgaccatttatcatgtaaaaagtcatcttcagaaatacagaacagctagatacagaccagagttatctgaaggctcttctgaaaagaaagtggcatcaaaagaagatataccatctattgacttgaaagggagttttgatctcactgaagcacttaggctccagttggaacttcaaaagcggcttcatgaacagcttgagatacaaagaagtttgcagctaagaatcgaggaacaagggaagtgtcttcagatgatgctagagcagcagtgcatacccggggcagaaaaggcgcaggatgcttcaaccgctgcagatgaattgaggtcaccttctgagattccagaatcttctaccgtcaaggaagttccagaaaacagtcaaaatggatcaaccaagcaaacaaaataagctaagggccgatgaagttgcaagcatgaaatgtgtttcatgatccgattggctgtttccaggcttaaatcaagttgtttttgtccttccgtgggaacagatgaacgctatagttaacttccttgcaaagcctggctaggtgcatgtaactaggagttagttgtatattacctaccctcacggtatcactgaatcccagtgttatgcggatgatgtagtcttcagaagacagcgcaagcacattgtcaggggtttgacttgttttgccccccattacttaggtatcaagtagcgtctcctaggcatttgattatgggctaattcaagtgtttacaataatgtttagcacctgttgtttaaaacatgtcatggtaccaaatatgacgaagatgtattgcatttatatgagagaatgagagatttgaactgctttagtttggtcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgttttaagggatccaattttacttccccgggtttgcaaggtaaaagtttttttttggggcccccaaatttaaattaa

SEQ ID NO: 1855 - DNA, 897 bp, Zea mays
  Predicted polypeptide sequence is orthologous to G1958
atttcggcacgagggttgcggggatgggggggcggttgcaatacaatactggatctggggggcctttgtgctcacctccctctgtaagggtctcttcacattcaaatcctgagcaataccccaaccacaattcatacaattctcaagtaccaagcactgcaagttcctcaacgctgggggagaggggacaacatgtttgtcctttaccatccataaccgatttcccaagagacattgaaccaacttggcgcccccatccaggtgagagcattcttggatactctggggatggccctgctgggaataatttgactgggaccactgctattggagggggagatgatcttactaagcaatctgaatggtggacagagtttatgaatgaggattggaaggacatggttgataacccgacttccacacaaactcaaccggttgggcaacctgtgcaatcatccaactcagttcaccaatcagctacccaacaaacagtgtcatctcaatctgttgaaccgttggcagttgtggcaccctcacccactgctggctccaatactggcaaggcacgcatgagatggactcctgagcttcacgagcgctttgtggatgctgtcaatatacttggtggcagtgaaagtgcgtactgcttgcagacatatgtctcccatgattgattcgttttgacattttccttaaattgttgcagaagcaactcctaagggtgtcctgaagctaatgaaggcagacaatttgaccatttatcatgtaaaaagtcatcttcagaaatacagaacagctagatacagaccagagttatctgaaggctcttctgaaaagaaagtggcatcaaaagaagatataccatctattgacttgaaagggagttttgatctcact

SEQ ID NO: 1856 - DNA, 1787 bp, Zea mays
  Predicted polypeptide sequence is orthologous to G1958
attcggctcgagggcagaggtgcgcttccccgtcgccccggccgcggcggcctgccggcctcctcgctcccccccagagtaatggattaatgctttaagcaaggtaatgaaatgtaccagaagtgacttatggaaaggaaggagcttgttcactgttctgaatgaggaagtttaatctgatgcagtctcaaaagagcagagttttgggagcaatgtcatcctctttgcctattctgccaaatcctttgaaagggagcttcccaaggcctcataacccccagcatattcctatgttgaggcagcttcctgatgactctatgcccttgtgtattgacacacatcagtctgttagtttgcacccaagagctggtgttatcggggtaccatattcaggctacactgctagtccacttgattctgtgtctaaccttgatagccagacaatggctgcaccctttatttctcagtcatccaattttgaagctctccagtctctatctgataataccccagaaacacacactaaggcagcctggttcacatcttctatggatgtttcaccactcaacacagataatattgctgcttctgatgttaatcaaatccatagtatacgtcctgctatgacatctgatgagagtgctacacaaaatgattggtgggcagatataatgaatgatgattggaaagatattcttgacgcaacagctactgattcccactcaaaagccatgattcaaatttccaactcagctacatcactacctgcagtaaatcagtcagcttcatctcatagtagggagatttgtcctgttgctagtcctcccaatagcagcaatgcttcagttgccaaacaacggatgagatggaccccagaactccatgaatgttttgtagatgctgtaaatcagcttggcggtagcgaaaaagctactcctaagggtgtgctaaagcttatgaaagttgatggtttgactatatatcatgtcaaaagccacctgcagaagtaccgcacagcccgctataaaccagacctgtcagaaggtacatcggaaaaaaggacagccactgaagagctggtcctggacctgaaaacgagcatggatcttactgaagcgctgcgccttcagatggaagtccagaaacggcttcatgaacagcttgagattcagagaaaattgcagttgcggattgaagagcaaggaaagtatctgcagatgatgtttgaaaagcagagtcaatcgagcacggagaaagtccaggatccatcctcaagggatacaacagctaaaccgtcatctaatcagagccagtctacaaacaaggatagtggtgcaaccatggacccaaatggaacaggagacatcgcacggactgcagaactgggagaacgttcgtctgaattaggtgtaaaacagaaactcgtagagatcgaagaatctggtaccgaagtagccacaggcgacagatctaagatctcccaagagaagcggcgcaaactgcaagatagttaacatatcggttgcactattcagacatagctgttcaaaccgtttgcttggtgaaaaattggtaatctgtgtgtcgaattcgactattgatccgtgagtccattggtgagttgtaccgctcttcagttagccatatatatttataaaggatccaaaggaggaccaaaggagaacttcctggcaaaaaaaaaaataaaaaaaggaacaggtgctatccccgaagttatggggtaaaataaggtcttgaaatttagctttcaaaaaaaaaaaaaaagg

SEQ ID NO: 1857 - protein, 291 aa, nicotiana tabacum
  Orthologous to G1958
MNDDDALTSNWNDIMLDTGIADAEPKMQYQEQKQPSNFPVHQGQPLQQVPTASVETSAIVPASSTASGASSKQRMRWTPELHEAFVEAVNKLGGSERATPKGVLKLMKVEGLTIYHVKSHLQKYRTARYKPEALEGSSEKKESSIGDLSALDLKTGIEITEALRLQMEVQKQLHEQLEIQRNLQLRIEEQGRYLQEMFEKQCKSIPSTDLVKASSSIAEDASAQSTDAVQRSSNKNDPAVPPSNPQEAGDYITQKVGEKQKEQEREDLGNLETNNSSSSNTPPTKRAKLDE

SEQ ID NO: 1858 - DNA, 1572 bp, Glycine max
  Predicted polypeptide sequence is orthologous to G2007
ggggaaaaccctgggaaaattatttcaaaacaaactcatttggttagaaaacccaccctaaaatcacggggaatttttccatgccacttattatcccacctttgggctaaaagctaagttcggggttattaaaaatcttttcctttaacttgggacttttttttcgtctacgtttttatccatttatttttaatgggacagtaaaacaggaaacgagagaatacaagtgaacttgtaatcacaaaagattttaccattattttcaaagtagacttctttgtacaatatgtttctgcactcactagacatttcccatttgttatgtccctaccgtacacataaatacatgcagcatttaattagaagaagaaagtacgtacgtactgtgccattttgatgatgatttggttttgctttgctatcaattttgtgttttggttggcgaggaacctcacaagaggaaacgttcaccttccaccttccgagagaaacatttttgtaaaatactaggtagataaaattcaacaccaagaacctaaatttgagcccgtggtattttgtcacatttatagatttgatatcttacccttaattttctttcatagacaattaaattcccgtgctaatgcccctcttccttcattcctatcgtttgcagtgcatgtgactctatctcgttgaaacaggtaaacccaaaatcatgaataccaaagtcttgacagtccaataaccaagcacaattatcctcccaagatggtaacaaacccatgttattactagtattctcaaggttaggtgttgtgtcccataatgcttccaccagaggagtttcatccagccacatgctgtttaatagagaatcgtcgctgcaaatgctatctagcaaaagtgaatcatccccagaagaattttcagcttgtgatgaacttgaattctcctctgagttgagaagaatcccttcagtttctttgacctgatcatcaaggttattgccaggttgcggcaaatgctctgcaggggaggatgaactatcctgagaagatgctgcagcttgttttttgagaggctcatgagtaacgggatcaatacctatcttaaggagttttttcttgatatgggtgttccaatgatttttaatctcattgtctgttcttccgggtaacctggcagcaatcttggaccacctgagacagcaatcggcatgcagatcaataacaagttgctcctctgcctctgtgagtagccctctcttcaagtctggacgaagataattcgtccaacgaaggcgacaactcttgccacagcgcttgaggccagcgagctttggcacggcgcgccaacagcattggccattggtgagaatgaagttgatgagcttcttgtcttcctcagcagtccatggacccttcttcaccccaagtttgtcacagcagggttgccttcccatagcactaacacaaaaacaacaccacttcctagctagctgaccaatattgcaattccccaaactaaatgcaaaagtcttaccaacactagcttgtaatgagtaatgacccccccttctgtcgtctt

SEQ ID NO: 1859 - DNA, 1076 bp, Glycine max
  Predicted polypeptide sequence is orthologous to G2007
ttttttttttttttttttcacgttcaaatctcgtgtgtatcactttcttgacaaataataaataaggagaactttatctaatattcatcaagaaagttataaacacaaaatttgaacgtgacatggacacgagaggatttattcccattttgtcacattcacatatacacatattttttgattgcatgctctgtttcttaaggacaactaactttaattaccatatgtactgcatcctaaagcccttttctgtccatgcctatagcttgcagtacatttgtttcaacctcgctgaaacaattgaagccaaaatcatgaataccaaagtcctggcagtccaacaaccaagcacaattatcctcccctattggtaagcccatgttattatttgcattctcaactttaggtgtattgtcccataatgtgtccatcagaggagtttcatccagccacatgctgttaattagagaaacatcactgcaaatgctatccaccaaaagggattcttccccagaagaattttcagccggtgatgaggttgaattctcttctgagttgagaaccccatcattttgctcaacctgatgaatgttaatgttattcacttgtgagaaatgctctgcaggggatgaactatctttggatgagacttgtttgttaagaggttcgtgagtaacaggatcaatacccatcttaaggagctttttcttgatgtgggtgttccagtgatttttaatttcgttgtctgtcctacctggtaacctggcagcaatcttggaccacctgttgccaagacgggcatggagatcgataacaagctgctcttcagcctgtgtgaggagccctctcttcaagtcaggccttagataattagtccaacgaagacgacaactcttaccacaacgccgaagcccagcaagcttgggaacagctcgccaacagcactggccattggagagaatgaagtttatgagttttttgtcttcctcagcagtccatggacctttcttcaccccaagtttgtcacagcagggttgcctccccataccacttgctagcaaccaatgtaaagtgac

SEQ ID NO: 1860 - DNA, 815 bp, Zea mays
  Predicted polypeptide sequence is orthologous to G2007
ggaggctcactccacgcagcagttgccaggcgcttgtcactccagccagcggcagcccttttccttggcgaggcttggtttagtttagcccgcctgcggtctgccgcctgccaagtgccacctgagacctgatagccgcaaccgtgagaggctggtagcccgtagccggcatccctcgccctcgacccatttgaacagggcctcgagctttgcctctgctgctgctcgcttgatccgtctcttgccgtagtatactacgcgtgctcgatcggcggcggcggctctacgacccgcggccgggatgggtcggcagccgtgctgcgacaagctgggggtgaagcgggggccgtggacggcggaggaggaccgcaagctcatcaacttcatcctcaccaacggccattgctgctggcgcgcggtgcccaagctcgccggcctgctgcgctgcggcaagagctgccgcctgcgctggaccaactacctccgcccggacctcaagcgcgggctcctcacggacgccgaggagcaggtcgtcatcgacctccacgccaagctcggcaacagatggtcgaagattgctgccaagctaccgggcaggactgacaacgagatcaagaaccactggaacacgcacattaagaagaagctgatcaagatgggcatcgatccagtcacgcacgaacccctcgaccggaagacaaccagcagcggcccggctacaacctctcagtcaaccaagtctgacgaggcgaccaaggagcagagcccgcagaacgacgacgccgtgataggggacgtgcccgccgatggttgca

SEQ ID NO: 1861 - DNA, 3330 bp, Zea mays
  Predicted polypeptide sequence is orthologous to G2007
ccacgcgtccggtcgcggtcgcgaccaagcgacgacggcgagggagggaatgtacgccgctgtcccccactctcctccccactcccaccgcagtccatcgacagtggagggttcccggaagcaaagcgccagcggcaggtaagcagaagcctggctagctggcctctggtatgtggttggctcaaggattacaggatttcaatcagtaacaatcaagtatgaggaaggaacaacaacgggtgtccaagcttgggtggttggcttgccggttacagcaagtcaattagtaactacagatgggaggaaggcgaccgacggtatggctgacatgagaccctgtctaactcatgtttcttccttccttccctcatcagccgtcccgtcgatcgggcaaataaagttgcgcctagggaggaaggaaccaggcggcaggctgcccgtgccgacgtggatcgggccagagctaggtaagtgcacctgtgggctgtggtcggcaggcgatcgaaggtgagtgagccggtgagccccgccatgcactgacggagtcactgccgactctcgtcgtccgatctctttttactgtggacgaatgggtgcgtgcagcctatctgcctatgggaagcgagagggggcccgggactgggttgagcaccttgtgcgcaaaggcatggtggcgtctggggccggctgcaggcgtgtgcgcacctgcacgagcgtgcagtcgcggcgcgtggctgcagtttggtgtgcctgggacggggactcgtgccgtgtgtcctgcgcgaggtggttttgcggctggctgacggaatggttgatggaatccttgcgtaaggacgcaactgagaggtaagcccccctcgtccccgtcccccgtgggaaacgggagtgccaaagccttgtggcacaccaaactgtagcttttgatcgtgcatggtggggcgcctacctgatgctacgcaaacttttgtgtcgcagcttcagttaccctgaagagcagggcaagctagcaaaaggtgaaagcgtttggtcacgtagaatccatacaggtcatacatatatagcagtcgcaactcgcaactcgcacgtagagcgtagaggttcaaatctgagccttagttcagaatgcagcttcagtttgggagttcgttcgtgcatagcaggccctatagctggggttagtcgtgtgcaaggattctccatgtggacaacacaacacaagcaagcaagctaatataaggttggatttaaaagtcgcagaacaattcatgacgtgcttggaaaacgttggtagcgtcttttaatgcttgatctaaaggctaagttatcatccatgggctaggtttgtttgttagtattaccctgtccagtgcaagggcaggtaggaggtagagagagaccgagcaagtactaacctttcatggccccggtctgcccccccagctccctctttcccttgggggccgctgtgtgctccgtcgccatcgcgggggataaaaggaaaaggctccgaggaaacagtataaaagcgcccccggcacgcacgcacgcacgcaggctcactccacgcagcagttgccaggcgcttgtcactccagccagcggcagcccttttccttggcgaggcttggtttagtttagcccgcctgcggtctgccgcctgccaagtgccacctgagacctgatagccgcaaccgtgagaggctggtagcccgtagccggcatccctcgccctcgacccatttgaacagggcctcgagctttgcctctgctgctgctcgcttgatccgtctcttgccgtggtacgcgtgctcgatcggcggatcgtcggcggcggcggcgggaagctctccgacccgcggccgggatgggtcggcagccgtgctgcgacaagttgggggtgaagcgggggccgtggacggcggaggaggaccgcaagctcatcaacttcatcctcaccaacggccattgctgctggcgcgcggtgcccaagctcgccggcctgctgcgctgcggcaagagctgccgcctgcgctggaccaactacctccgcccggacctcaagcgcgggctcctcacggacgccgaggagcaggtcgtcatcgacctccacgccaagctcggcaacagatggtcgaagattgctgccaagctaccgggcaggactgacaacgagatcaagaaccactggaacacgcacattaagaagaagctgatcaagatgggcatcgatccagtcacgcacgaacccctcgaccggaagacaaccagcagcggcccggcccacgcgtccgagtcaaccaagtctgacgaggcgaccaaggagcagagcccgcagaacgacgacgccgtgataagggacgtgccggccgatggttgcagcccgacggaatcgagcacgaacaccgtgagcaccggcggaagcagcagcagtggtggcggcggccatgaccaagacccgctggtgaagtggcttttggaagaggagcctgccaccggcgacgaggcgtggctgaacttcactggcagtgtcgacgtggacgagttcagcagcattgccgccggtccggagttgttgccgtgggatggcgcgaccgactggctgctcgactaccaagattttggattgggggactcgagcttggtcgatggctacatggtcaacaacaacagctcaaacggagcaaagttctagctagctagccgaagatgtcatctcatctgcttgtgttgctttgctgccagtgaacgtagatacgtaagtaataaaagcattggtatcgaggttgtcaaaggtggatgaccacatcgcaggaagatcatgaagagtccttgcacgcactcctgtatctcgaaccaactaacggctgggatgcaattgagaaggggaggagcacaggccaatcaatctcaaagagataaaactggttcttgaagatctcgaagaaagatgtgtttcttcacaatcacaaagagaggttgtagaagttcttgctgttgtatacatggttgcgtatatattgctaaattgtaccttgttaggccattttgttcgcaaattgcacgagtcactaattagtcagcaaaaatgtgtgcataaagaagagcagttgaaatccccgcggcccgcgcggtgggtgacgttcttttagttacgttgtggatgacgttgatgcatttatagggtatttggtttgaggaataagttatctggtttgtagaatggaataagttatccatcatcacctcattaatcatggttagtactaacatgagtaattgagtcattccaccaaaaaaaaaaaaaaaaaaactcgagagtacttctag

SEQ ID NO: 1862 - DNA, 399 bp, Zea mays
  Predicted polypeptide sequence is orthologous to G2007
  misc_feature (309)..(309): n is a, c, g, or t
ggtgatagtaaatgatcaatggggagacagccggctgtgacaggagggggtgaagcgagggccatggacagcggaggaggacaagaagctcattagcttcatcctgacacatggccggtgctgctggcgggcagtgcctaaactcgcagggctgcttcgttgcggcaagagctgccgtctgcggtggactaactatcttcgccctgacctcaagcgtggcctcctcagcactgccgaggagcagcttgtcattgacctccatgccaagctcggaaatagatggtcccagattgctgccaagttgcctgngagaacagacaacgagatcaagaaccactggaacacgcacatcaagaagaagcttgtcaagatgggtgtcgacccggccacacacgagcc

SEQ ID NO: 1863 - protein, 326 aa, Oryza sativa
  Orthologous to G2007
MGRQPCCDKLGVKRGPWTAEEDKKLMSFILTNGHCCWRAVPKLAGLLRCGKSCRLRWTNYLRPDLKRGLLTDAEEQLVIDLHAKLGNRALAPTSLISVAKRTLHVDSEIESILLGPVASLENGRKLFKKWSKIAAKLPGRTDNEIKNHWNTHIKKKLIKMGIDPVTHEPLDRKQESPATTSQSTVTAESSKSGEATRQQSRQLDDAVVRDMSVSAGGDSPPESSTNTASTAGGSSSSSSSHHQDPLVKWLLEEDLLPTGDEPWLNFTASNDVDEFSSIAATGATPALPWDVGMTTDWLLDYQDFGMGDSSLVVDASMVNSSNGSNF

SEQ ID NO: 1864 - DNA, 1031 bp, Glycine max
  Predicted polypeptide sequence is orthologous to G2010, G2347
tcctctaaagcggccgcttttttttttttttttttttttttttttttacccaaaagaagcaatatctttttattctaacccaatggaagataagagcacaccccaatcaagaagggtgcttctataggataacaatggtgataaggcaaacagaaaaaaaaaggcactctatccaaataagaaaaacagagctcaggaaactagctagcttacattgcatattaagacatcaggctttggctgttggaagtttttgggatttttgattcttgctcatgtgaacatacaatacaaagtggtttttattatataccttgggttgtaagaaaccaaagggtgacagaagagagagagctttgtgaacactttggcttcatctgatgttgaaagacttgtagccggaactccctggtaggttcatctgaattctctccctctcatttgcaagcctgcagtgtgttgtttccttagggtgatggcctttggtgctgccctcattggaagcttccgggttgcttttccggcgccgctcgttgtgtccggccaaccggcggcggcagcttctcttggattcatcaaactctgccaggtcatggaacctgctacattgctggcaaaacctctgccttagccctgcaaccaccacaacaggtgcctttgaatgaaactcacacaccttgtggcggcgatggtacctctttgcatcagttaaatcagcaccacacctctctgcttgacatgaaggtggagaaacccctccactacctccacttgaccctcttctcccaccactactaccaacccctttcttcttctcttcttcagtaatactaacgccactttcatcctcctcctctacttcattttccacttcctcttccactgtgctattctttctcaccctctcaaacaatgctctctccctctccattgtgcaaaggggtggtgacaatgatgaaggatatgcttgttgttgagctaggacttttggagccccttctgtctcttctcgcagccgtacggacgcgtgg

SEQ ID NO: 1865 - DNA, 1403 bp, Oryza sativa
  Predicted polypeptide sequence is orthologous to G2010, G2347
ggtctctctctctccctctctcctcctcctcctcctcctccgccttccacttccacttccactcatgagctcgagctcgagctagctctagctctctccaccctcctccagccaccgcttccacctcccctaggaggctagcacacagcacacagtagcactagctcgtcgtcgatcacgcgcgccaccgcccatggaccgcaaggacaaggcccgcaagaacttctcctcgtcgtcctcctcctcggccgcgtccatggccgcgctcgccgccgcggcggccgcgggggacggcggggcggcgctgccgtcccccatggaggaggacaagaagcccaggctggtggcgtcgtcgctggcgcccgtggcaggcggcggcggcggcggttcctcctcgtccgctgctgttgctgctggcgcgtcttctagctcctcctcctcctcggtggccgcggcggcgaggaggggcgcgggccgtgccggcggtggcgccccgtcgggcggcggcggcgggccgaggtgccaggtggagaggtgcggcgtcgacctcagcgaggctgggcggtacaaccggaggcacaaggtgtgccagacgcactccaaggagcccgtcgtcctcgtcgctggcctccgtcagcgcttctgccagcaatgcagccggttccatgagctgacggagttcgacgacgcgaagaggagctgccggcggcggctggccgggcacaacgagcggcgccggaagagcgcggcggacacggcgcacggcgagaactgccgccacgccgaccaggacgccggccggagccaccagggcaccgggaacccgccgttccagatcagataaacctacctaagcatgctccctctcttctgtcatgcagccatgctagtgtgagtgtgtgtgttcgtgccactactactactacatgtctacatcgatctatctacctatatatatccaccacctacgtcccttcttcctcaaatcaatcaaatctatctatctatctatttatctatccctgaatctatctctatccggtgtgctttgctgctgctgattaactggcagtgtgatcatctccctctactgctgctacatatatgcagtgctatgctggagaggcataaatgtgctatatatatgttctctgccacaaccctaagctaattgtaacctgttgattaagcaggtgttctagggattctctctctctctctctgtgtgagggtgtgtttgatgtgtaattgtactattgcctttgcccaacagaaacttgtaggctgcagtgtgcctatgtatgctgttgtgccgggatggcagtggtaatatatgctgtttgagtcaaaaaaaaaaaaaaaaaaaaaaaaaaactcgagactagttctctctctcctcgtgc

SEQ ID NO: 1866 - DNA, 777 bp, Zea mays
  Predicted polypeptide sequence is orthologous to G2010
tatgccggactcctcctcctccgccggcacaggcggcatggccccctcgagctcggcggcgccgggccgagctgccaggtcgagcggtgcagcgccgacatgggcgtggagaagcggtacaaccggaggcacaaggtgtgcgacgcgcaccgcaaggcgtccgtcgtcctcctggccggcctccgccagcgcttctgccagcaatgcagccggtaagccccgcctgcctgcttgctcggaggcacatgcacatgggcgcagtgcagtgtgcagtccggccggcgtgcgtgactcgtacgtgagtgagttcgtgacatgctcaaaggcaccggccgctttcagtttgtacgggtactactactactaaactaaacgagcttaattcgaccttgaaaagtaaacttgcttgcctgaagcgcatcgggtcccttgagaaagcttgcagctttttttcttgggtcatggatagcacggtgagctgctggattggatcctaagctagctaggttgctctctcaactcaagatcttgcagaagcgtctctcagtctcatgcaacctctttggaggttattaatcaaaccgtgctagctcctctgcctggagcttctctccgcctgtgtcactctttcttgacccccggccctcgtctgctcgcaggttccacgagctgtcgcacttcgacgacaccaagcgcagctgccgcctgcgcctgggcgggcacaacgagcggcgccgggagaacccggcggaggcgcaagaccagcacggcgggcgg

SEQ ID NO: 1867 - DNA, 1108 bp, Zea mays
  Predicted polypeptide sequence is orthologous to G2010, G2347
gcggcgtccggcgacggctcggacgactccggggcggccaacaacaacggcgcgctgccgctgccgctgccgccgccgcacggggtggaggacaacaacagtcccgcggagctggcgggcgcgggtggcacctcccgggcggtggcgaggagggtcgcggcggccggcgcctccccggcggcggcggcgaggaggggcgccgccttgaacgccgcggcggccggcggcgccgggccgagctgccaggtcgagcggtgcagcgccgacatgggcgtggagaagcggtacaaccggaggcacaaggtgtgcgacgcgcaccgcaaggcgtccgtcgtcctcctggccggcctccgccagcgcttctgccagcaatgcagccggttccacgagctgtcgcacttcgacgacaccaagcgcagctgccgcctgcgcctggcggggcacaacgagcggcgccggaggaaccccgcggaggcgcaggaccagcacggcgggcggggcgacccggggagccaccacctccagatcagataaaaacctactacgtcagcatgctctctctcttctgtcatgcaggacgcacgcacctagcgtcgtcaccgatccatagtccgatatgtgtctcaagtgttgtgtgtgcgcgctctcgccgcctacccctgtcctgcagtgttgcgtagtatatggttctacgacctacacgtactgctgctactactgcgtgctaactttaatctgatggcagtccacagctagctagcacatcacctcctgtaagtaatgtgcttatctatatgtgcaccgaccggaaccggaggcgtgcgtacctacgctgatctgccacgaagcctactagtagttaaatgtaacgtaacctgcaggcaattaagcagggcgctgctatatatagcgtaattaattgtgcgtatgggtatggtggttcgattatcggatgtgtaatccctgtacgtggccgggcccgtgccaaagcgtacggtgacctgtgcaggctctgtgtgtcgatgatgttgtactctgataatgatataatccattgtggtaatgtatgctatttaaaaaaaaaaaaaaaaaaaaaaggcggcgctcg

SEQ ID NO: 1868 - DNA, 554 bp, Glycine max
  Predicted polypeptide sequence is orthologous to G2059
cagtggcttccctagcatcttcttctgccagaccaaaatttccaaacttgactttgtttttgccggaaccctccatggtgtactcatcaatatcatcctcaaatataaaaggtggtgaagtcatgtcagctacttcagacccctcatatcatgtgtctcagtttggccaaaaccagcatcaagcaggtagtggggatgcacacaaaatgaacaacaacctaacaaattcgcggtccaagtctttcaacgagaattggttgagtgccactaggactcagcctttgaagtatggtggaagaggcaagctgtttaaaggtgtgaggcagagacactgggggaaatgggtagctgagattagattaccaacaaacaggacaagggtttggctagggactttcgactccgccgaagatgctgccatcgcatatgacacagcagcatacatactacgaggagaatatgctcaattgaacttcccagaactcagcatgtaattcaagcaaattctctgaaaggctaccactgctgcacttgtggaggcaaaatacaagcaa

SEQ ID NO: 1869 - DNA, 1301 bp, Glycine max
  Predicted polypeptide sequence is orthologous to G2085
attcggctcgagctccctttcattttccctcacactcatcattctcaaaaaacacgcccaaattctaatcaaattagggttagggttttcaactcccctcgaattatccctgtaatgcagtgcgattcccgggtcctaccatggagccatcagcaatgtacggaccctcccagcccctgaacatcccctcgcggatcggcgctggcgaaagagacgacggctccggcaacgagcccgccgtcgacggccaccaccaccacattcagtacgaaacgcacgcgctcgatgacggtgccgccggtggcgccgtggttgtcgaggatgttacgtcggacgcggtctatgtctccggcggtggaggccccgaggagtccagccagcttacgctgtcgtttcgtggccaagtttacgtcttcgatgccgttacgcctgataaggttcaagcggtgttgttacttttgggtggatgtgaactatcttcgggtggttcgccatgtgtggatcctggggctcaacagaatcaaaggggttcaatggaatttcctaaatgtagtctaccacaacgagctgcctcattagataggttcaggcagaagaggaaagagcgatgctttgataaaaaagtgagatatagcgtacggcaagaagttgcgctcaggatgcatcgtaacaagggtcagtttacttcatctaagaaacaagatggagctaatagttatggtactgaccaagattcaggacaggatgatagtcaatccgaaacctcatgtaaacattgtggcactagttcaaaatccaccccaatgatgcggcgagggccatctggtccaaggtcactttgcaacgcttgtgggcttttttgggcaaataggggtgctttgcgagacctttctaagagaaatcaggaacactctcttccaccagttgagcaggttgatgaaggtaatgactcggactgtcggactgccactgccgaccctgcacataacaatcttcctgctttctcagagcatgataatccagctttggtagctgatcataaagttttccagtctcagaaaatgttgaagtagtttactctggcataagtaggtctatagttcttccattcagattgaccaataggaatgtacagacataacaatactcccatcaatgcaagaactttgtttttatatggttggatctatggcattaaccattgatctctggatgtataacctgaaacttgaatgatgacttggtgatggtctcacccaataccttgaatttaattttacacgtagattttttgttcaagg

SEQ ID NO: 1870 - DNA, 1549 bp, Glycine max
  Predicted polypeptide sequence is orthologous to G2085
atgcagcgtcaccggtgcgcgactccacgcgtccgggacactttaacagcattctctctctctcgagtctcttccccccgactcggcgccccgccgccccccgcaacacaacggacacattctgagactatttatagttatccccattctggttatgttctttctttcttactccctctcaatcaaaccgtgttagggttagaactaagattagggtttctttactttacccgcgtaatgtaatgcgtcgaaaacccccaattctaccctccttccaacaacaacaatgttcggctccatgaacaagatcgtctccgctgaagacaccgacggctccgtctccgaccaccacatccattacagttcccacaccatcgaagacgacggcgccgcctccgatcaccacatccattacagttcccacaccatcgaagaggacggcgccgtctccaaccaccacatccattacagttcccacaccatcgaagacgacggcggcgccactgtcgaagaggtttccgccgttccgccccttgaaatctctatcaacgattctagccagctcacgctctcgtttcgcggccaagtctatgtcttcgacgctgttacacctgataaggttcaagcagtgttgttgctgttgggaggaaatgaactaacttcgggttcgcaatgtgcggagctatcatctcaaaatcagactggtgaggaggaatatcctgcaaaatgtagtctaccacagcgagcagcgtcattgaataggtttcgtcagaagaggaaagagcggtgctttgataagaaagttagatatagtgtacgtcaagaagttgcactcaggatgcatcgaaataagggtcaatttacttcatcaaagaatcaggatggaactaatagttggggttcagatcaagagtcagggcaggatgctgttcaatctgaaaccttgtgccacacattgtggaataagttcaaaatccactccaatgatgcgtaaggggccatctggtccaaggtcactttgcaatgcttgtgggcttttttgggcaaataggggcactttgagggatctttctaagagaaaccaggaacactctcttgcaccacctgagcaggttgatgagggcagtaataataatgactttgactgtcggagtggcatccctgcacaacataacaatcttgttaatgataacaaagctttggtatctgatcgttgagttttccactcacaggaaatgcaagtccttgactgtgacattcgcaggtttttagtaattccattcagtttgacctatagaatgtacagtatatagcaaagctctcgtcaatacaagagcggtctatttctatactctctgatcagttgcattaaactgtttatctatgactgtacaaactggaatttggaatgacttgatcgcatacaagagatctattcctttactctcggacagttgcattaactgttttatctatgaatgtataaactggaatttgaaacgaacttgatcctcattccgtggtctggtggttttagtttagtctagtg

SEQ ID NO: 1871 - DNA, 1380 bp, Glycine max
  Predicted polypeptide sequence is orthologous to G2085
  misc_feature (485)..(485): n is a, c, g, or t
  misc_feature (562)..(562): n is a, c, g, or t
tattatttgcagctgctatgtttgctgtagcggccattctatagtcaacaattccaatacagcattttcgggggtagtcactcgactcactcccagccatcttccttcattaactactttatttgtttcttactttgttactattgtgtgacaaattttgaccttttaatacatttaagatgaaattgacattagtgcttttatgtttttgcttccccttcccatatgacaaattgtgtacaacaagatttcaaatataaggcatgcttcaacagcatcctctgccagcaagttggatatatatgctcaagtgaatggctaattttggacattgagatttttgttgctatagccatgggtatgcgtgtgtgtgtgtgtgtattggtatgtacatggttgcattggtttaacaaattgctttggttttatcagcaagaacctttttgggcatttgttatttcatatgtaattaatgctatcaaagnaagaagttcatatcttcccacggactattgcacatcatctatgttccacattttattcttattgctcaccattttanggtgtttgatttaatttgcatcaatgtatatttcttatttgatttttaaatgtagcgtcaagaagttgcactcaggatgcatcgtaataagggtcaatttacttcatcaaagaatcagggtgggactaatagttgggggttcagaatcaagagtcagggcagggatgctgttcaatctgaaaaccttgggctgcacacattgtgggaataagttcaaaatccactcccatgatgcctagggggccatctggtccaaggtcactttgcaatgcttgtgggcttttttgggcaaataggggcactttgagggatctttctaagagaaaccaggaacactctcttgcaccacctgagcaggttgatgagggcagtaataataatgactttgactgtcggagtggcatccctgcacaacataacaatcttgttaatgccggcccagcttaacaatcttgttaatgataccaaagctttggtatctgatcgttgggtttcccccccccaggaaatgcaagcccttggctggcacattcgcaggtttttagtaattccattcagtttgccctatagaatgtccagtatataccaaagctctcgtcaatacaagagagctctatttctatactctctgatcagttgcattaaactgtttatctaggcctgtacaacctggaatttggaatgacttgatctcatacaagagatctattgctttactctcggacagtggcattaactgttttatctatgaatgtataaactggaatttgaaacgaacttgatcctccaaaaaaaaaaataaaaaaaaaaaacaaaaa

SEQ ID NO: 1872 - DNA, 499 bp, Glycine max
  Predicted polypeptide sequence is orthologous to G2085
tgaacaaaaaatctacgtgtaaaattaaattcaaggtattgggtgagaccatcaccaagtcatcattcaagtttcaggttatacatccagagatcaatggttaatgccatagatccaaccatataaaaacaaagttcttgcattgatgggagtattgttatgtctgtacattcctattggtcaatctgaatggaagaactatagaaaaattatgccagaggaaactacttcaacattttctgagactggaaaactttatgatcagcttccaaaagctgattatcatgcttctaaaaagccagaaaaatggtattttccagggccggaagggcaatcccaccagtccaagtattaaccttattaaaccggctaacctgggggaaaaaagggttcctgatttctttaaaaaaggtctcgcaaagcacccctatttgcccaaaaaggcccacaagcgttgcaaagtgaccttggaccaaatggccctcgccgcatcattggg

SEQ ID NO: 1873 - DNA, 1309 bp, Zea mays
  Predicted polypeptide sequence is orthologous to G2085
aacaaaaaatctacgcgtaaaattaaattcaaggtattgggtgagaccatcaccaagtcatcattcaagtttcaggtgatacatccagagatcaatggttaatgccactgatccaaccatataaacacaaagttcttgcattgatgggagtatcgctatgtctgtacattcctatcggtcaatctgaatggaagaactatagacctacttatgccagagtcaactactccaacattttctgagactggaaaaccttacgatcagctaccaaagctggattatcaggctctgagaaagcagcaagattgttttgtgcagggtcggcagcggcagtccgacagtccgggtcattacctccatcaacctgctcaactggcggaagagagtgttcctgatgtctcttagaaaggtctcgcaaagcacccctatttgcccaaaaaagcccacaagcgttgcaaagtgaccttggaccagatggccctcgccgcatcattggggtggattttgaactagtgccacaatgtttacatgaggtttcagattgactatcatcctgtcctgaatcttggtcagtaccataactattagctccatcttgtttcttagatgaagtaaactgacccttgttacgatgcatcctgagcgcaacttcttgccgtacgctatatctcacttttttatcaaagcatcgctctttcctcttctgcctgaacctatctaatgaggcagctcgttgtggtagactacatttaggaaattccattgaacccctttgattctgttgagccccaggatccacacatggcgaaccacccgaagatagttcacatccacccaaaagtaacaacaccgcttgaaccttatcaggcgtaacggcatcgaagacgtacacttggccacgaaacgacagcgtaagctggctggactcctcggggcctcctccgccggagacatagaccgcgtccgacgtaacatcctcgacgaccacggcgccaccggcggcaccgtcctcgagcgcgtgcgtttcgtactgaatgtggtggtggtggccgtcgacggcgggctcgttgccggagccgtcgtcgctttcgccgccgccgatccgcgagggcatgctcaggggctgggagggtccgtacattgctgatggctccatggtagtaggacccgggaatcgcactgcattacagggataattcgaggggagttggaacccctaaccctaatttgattcgaagttgggcgtgttttgtgagtatcatgtgtgcgtgggcgtgtgaggcgggggagaatgaaagggagtgaagag

SEQ ID NO: 1874 - protein, 784 aa, Oryza sativa
  Orthologous to G2085
MAIDGFLLLSNSLAAAAAAFSSALSATCTPEMRRRLASGPQDRCPHTSAISEGTGYSTRWERGVGGGDAMMHMLVAPDGGGGGEMPPPYGGAAAAPPPPMEQELELHRDNADDGLDGHVRCLRCGISGNATPHMRRGPDGPRTLCNACGIAYRKGKMRRMIEAEPPIDEAALAKLVPEVGMEFESEDKAYEFYNKYAGHVGFSVRKSTSHKSSGNITKVRTFVCSREGYNRDKKSLEAKKPRLDTRIGCPARLIIKVTPESKYRVTDFKADHNHQLAPPSTMHMLRSQRILTELQSGEAELSDDSVMTPTTKATGDLVVRQIGFLRSISLLPADYKNYLRSKRMKAMQLGDGGAILKYLQTMQMENPAFFYTMQIDEDDKLTNFFWADPKSREDFNYFGDVLCLDTTYKINGYGRPLSLFLGVNHHKQTIVFGAAMLYDESFESYRWLFESFKIAMHGKQPAVALVDQSIPLASAMAAAWPNTTQRTCAWHVYQNSLKHLNHVFQGSKTFAKDFSRCVFGYEEEEEFLFAWRSMLEKYDLRHNEWLSKLFDERERWALAYERHIFCADIISALQAESFSSVLKKFLGPQLDLLSFFKHYERAVDEHRYAELQADFQASQSYPRIPPAKMLKQAAHTYTPVVFEIFRKEFELFMDSVLFSCGEAGATSEYKVAPSEKPKEHFVRFDSSDCSCICTCRKFEFMGIPCCHMLKVLDYRNIKELPQRYLLKRWRRTAKSANEENQGTLLFLICMRIHFAEAHDAGDLNLNIIPSARCLLHDTGVEAVR

SEQ ID NO: 1875 - protein, 76 aa, Oryza sativa
  Orthologous to G2105
MPLTLLCLAFSPFAWPPSLPPPPQTPDAIAGCKNKAEAGAGRWLRQDTLELLTIRPEMDTVLQEATLNGAIWEEIS

SEQ ID NO: 1876 - DNA, 445 bp, Glycine max
  Predicted polypeptide sequence is orthologous to G2110
ccagtggaggaaatatggacagaagatagcaaaaggaaatccatgtccaagagcatactatcgttgcacacttgctccagcatgcccggttaggaaacaggtgcaaagatgtgctgatgacatgtccatcttaatcaccacatatgaaggaactcacaaccacccaattccagcttcagccacagccatggcttccaccacttctgctgctgtttccatgttgttgtcaggctcttcaacatctcagcctacagatcacagttttgcctatcatgcaaattctcctacactgttcagtggtgtcaatttcagtcttttagaccaaccaagagcaaaccaagtcttgttaccaaccccttcctcacatttactcccaacaatcactctagaccttacttctactccatcctattcattaaatcaagggaattgtttaccatcaaac

SEQ ID NO: 1877 - DNA, 809 bp, Oryza sativa
  Predicted polypeptide sequence is orthologous to G2114
gttcgaaattcatcgagaatgtgaactctgaacagaagaatccccacaaacgtgcagtcattttcaatgacaacgtgttttttacaatctggaatgataggttatattgagcagaacataaatattgagttgctcaggtgttgtacagatctaccctactcaacctataatacatgctcaaaatctttcttgctgagacgaatttgctagtcaatcgaaaattgagctgtaatttgtagattataacgcagagatattaacaagctgcaaccagttgtatctgtatgtaccactaagctccaaatatgactgaaacaaccctaatatgcgatgcggctccaccaagtcaagttttcattctggcttagacgcaagcagcttcaagcctgccccttctatacagtgcatacccttctccatgtagttgcttcgatcaaagttggtcaccgcatttttgccacggatctcaatagcagcaatgtcgtaagcctccgctgcttcttcctcagttttgaaagttcccaggtaaatgtctcttgttccagcaaccagtcctatgcgtgcctgccacctcccatctttctgccttctagtaactcctctataaatagaagcccctcttgagaagcagctacttcttcttcttaggtatgttacgcattcctctcgagacatgtcccttatgtcctccagttccctttcgtattctgaaaccgaggaattcagctttgtattttggccccagtatttaagagctgcaacatcatatgacctgggcagctttttcctcgggatcataacttcctaaa

SEQ ID NO: 1878 - DNA, 1204 bp, Oryza sativa
  Predicted polypeptide sequence is orthologous to G2114
  misc_feature (585)..(585): n is a, c, g, or t
  misc_feature (588)..(588): n is a, c, g, or t
  misc_feature (596)..(596): n is a, c, g, or t
  misc_feature (620)..(620): n is a, c, g, or t
  misc_feature (631)..(631): n is a, c, g, or t
  misc_feature (742)..(742): n is a, c, g, or t
  misc_feature (744)..(744): n is a, c, g, or t
ttttttttttttttttttttttttttttttttttttttttttttttttttttttaacttgcctagctatcattatgccaaagagtaatatcaaccgaacacccccaacatcacatggtcctatctctggagctggtaaacaccagcatgacaacacggcagataagaatatctcgaaaaacacatacaagcgcgggaaaactaaaaagggccaacttggtgttaaaaagaaaataaataaaacaaaaaacaatttacaagttgtattcttttatctatcgtccagcgagcttcgcagccttcgatggaccctctagtagctttggaacctctgatgaggcttctaattttttcaaaccatcttcacagtagttactaatatcaaagttggtcacagcatgggcaccacgaagctcgatggcagctaggtcataagcttcagctgcctctatctccgtttcaaaggttccaagatagatgtctttggtgtctctactttctccaatcctaccaatccgtgcttgccatctaccatcctttcgccttgttacacccctatatgatgaagttccccttgagaaacagntgntctgcttnttatgaacaccacaaattcatctngggacatggtnttcatcctctcgatttctttctcataatcagaaacattgaagttaagtttggtgtttggccctgcaccccaatatttaagggctgcaaggtcatgtgcccttgcagcattntnttcagtaacatagcttcctaggtacacatgcttccccttgcgcttgcggccctcgacctggctgctgttgtcccagaggtgcgcctcgaacttgccgctccacttcaacctcgtgacgccgtggtaccgcgacgaccgcggcgcggcgtacttgcgcatggtctccgccaccagcttccctcctcctcctcctcctcctccctccgccgccgcagccgctttcccatcatccccgccgccgtccgcgacggccagctgctcgtcgagcgccgcgatctcctcgccccccgccgcggccggctgctcctccgtctccggaggaggaggaggcgcggggtccgaggcggcgggttgcacggtggccatcgccgcgaggtgaatcttcttcttcttggatttctcctcggcgaaatcttcgagagctcgtcgcggcgcaaaccctagccgccggcccttgtcc

SEQ ID NO: 1879 - DNA, 552 bp, Zea mays
  Predicted polypeptide sequence is orthologous to G2114
gcttagcatccaattccattttctagcctcctcaatgtttggctgaatgcattcgattcgaacgttaactcaccttcttgttcttgcaatgccaatgcaatgtcaacaacgacgagcagtctacctaggcggctatgacagggaggagaaggctgcgagggcttatgacctggcagctctcaagtactgggggcccctcgactcaacataaatttcccgctgagccactacgagaaggagctgcagcagatcaagcacatgtcgaggcaggagttcattgcacacctgagaaggcatcaccagcacgggagatggcaggccaggattgggagggtcgctggcaataaggacctgtaccttggcacattcagcacgcaggaggaagcggcggaggcgtacgacatcgcggcgatcaagttccgtggcctcaacgcggtgaccaacttcgacatcagcaagtacgacgtgaagcgcatctgcgccagcacccacctcatcggcggcgccgacgcgtgcaggcgctccccgacgcggcaaccgactagtgagctc

SEQ ID NO: 1880 - DNA, 1292 bp, Zea mays
  Predicted polypeptide sequence is orthologous to G2114
ctccagggaccagatccggggtcggccgcacccgctcccgcgcacttgaagattcgcgaaagacagcgcgaccgacccacggcgatggccaccgtccaccctcaatccccggcgggtcccacccatctcccgcaggaggagcgacacggggacgccccggtaccgcccgccgtctccggcgaacccgccgccgcagcggaggcgggcggcgagatcgccgcgctcgacaagcagctcgccgtcgtcggcggcggcgaggagaggaggccggccggggccggggccggggccgccagcgcaggcgggggagggaagctggtggcggaggccatgcgcaagtacgctgccccgcggtcgtcgcgcttccacggcgtcaccaggctcaagtggagcggcaagtacgaggcgcacctttgggacaacaccagccaggtccatgcccgcctgcgcttgggctcgcccgtgtacttaggcagctatgtcgatgaagagcaggctgcaaaggcacatgatttggctgcccttaaatattggggcacagggccaaacaccaaactgaacttcaatatttctgattatgagaaagaaattgaggttatgaagaccatgtcccaagatgaatttgtggcctacataaggagacaaagcagttgtttctcaagaggtacttcatcataccggggtgtaaccagacggaaggatggtaaatggcaagcaagaattggtaggatcggtgagagtagagacaccaaagacatttaccttgggacctttgaaactgaagaagaggcagcagaagcttatgacatcgcagcgatcgagcttcggggtgttcatgcagtcaccaactttgacattagtaattactgtgaagatggtttgagaaaattagaaggcccatcagaggtggctaagcttggaagtccgtcggaggttgtgaagctcgctgggcaatagatactagattagcaacgtgtaaattagtttctatttcgtttcttttgtcttcatattctctcccttttgtattcctggttttttttgccgttttgtgatttcctccttgccttattggcaagccagtatttacccgattcgaaaggacaatgtgatgttgtattttagcctcacagaaaggtattactaacctttgatgtcactgcagaagtcgacaccatgttagaaatttagttcattcgtcgatgagcatgtctagtgttattatataattgtaagctactgtttctaatgggggaggaatgaaaacagaacatgaacataagttgcattgt

SEQ ID NO: 1881 - DNA, 516 bp, Oryza sativa
  Predicted polypeptide sequence is orthologous to G2117
ctgcagtaagcagaatcaaagcagattaaccctcatctacttctggccctctaagagttctccactaagcaagcgaaaacagccatgctgcaccaccattaccatggcgaggtggccagcctgcactgcctctcacctgcaagcctaccattcagttcccactaccacagcaacatgatcaccatggcaccctcgcccttccacttcccagcagctacctgtgaacctatccaggaattgctccctgtggtagcgggcaatcgtccagccggctctggcagcacagatgacgcctaccagatggcagcggaggaggagcggaggcggcggaggatgatctccaaccgggagtcggcacggcggtcgcgcatgcgcaagcagcggcagctcatcgagctgagggggcaggttgtccacctccgtgacgccaaccggcgccttcttgatgagctcaaccaagcaatgaggggctgcagtgatgtccactgcgagaacactctgctcatgaaggagagg

SEQ ID NO: 1882 - DNA, 666 bp, Medicago truncatula
  Predicted polypeptide sequence is orthologous to G2130
ctcatcctaaaggtttataggctataacccttcttcttcacggttctctttatattctaaaaccgggcctatttgttccttaaccacacacactcttttttctttgtcataagagtcaaacacaatggaaaaacagagtatcctatgcaaatacacagaacatgaaactgttacaaaaaaactcatcacaacaaagaaaaatggtcacagtaacaacaacaacaatacaaccataaacccaagagttgtaagaatatctgtcaccgacccagatgcaaccgactcatcaagtgatgaagaaggacaaatacaaaccttcagaaacagaacaaaacgttatataaaccgtattgaaattgaaaccactacaaaagctgttgttagcagaaaaagacccgccggagaaacatcaactgtacgacggccggcgaagattccggcagtcaacaacggtaaaaagttccgtggtgtacgacagagaccatggggtaagtgggctgcagagattcgagatcctgcacggagggttcgtctttggttaggtacttttgaaactgcagaagaagctgctatggtttatgacaatgccgctattaagcttcgtggaccagacgctttaacaaacttcctcacaccgccgctgaaagaagatattccggtagaacc

SEQ ID NO: 1883 - protein, 276 aa, Oryza sativa
  Orthologous to G2130
MSPADSLAAGRSRRVGASMPRPKRVRVYFVDADATDTDSSGDERSRPRVREVIDIDVGAASPAPAPKHPRRLVPTATAALARRRAGMAASRRFRGVRRRPWGRFSAEIRDPSLQKRLWLGTFDTAEEAAAVYDDAALRIKGSHAVTNFPSDSDTPSAKAKQMKLHPRRHTTPDKTPSSSTAAAAKASVPDPTPAPPEEDRANDSSFNPFASPTSVLRYAAADEVTAPSFEHLLVELGDLSAPPPSTKAAEFDWLPWWEGEDFVTAGLTASNAVSVK

SEQ ID NO: 1884 - protein, 342 aa, Oryza sativa
  Orthologous to G2130
MVEVIVEKKARRIVRGRWHVEASNEAAAAAPAVAAPAPRVVRVLCRDHDATDSSGDDDGEDDAPRRARLLVHEIHVARQPVAMSPAAASSSQRRRVGPMKRTESAVDATMDATAAAPERKFRGVRKRPWGKYGAEIRVSQQSARVWLGTFDTAEEAARVYDHAALRLRGPSATTNFPMTPAAPSPPPSRATYAGAASGYDESSDESQLVGSPVSVLRPMPARATAKKEAKEEDDSAPDILGISAGDGLISPFTCDVLNFPPPDEDMFGGGISFGEPTPPPMVFDDDCMARLGHAPNDDEHPVTSSSFLDGDLGDLPSWTEVDGFFSDVGGDDLFAAEPFPAL

SEQ ID NO: 1885 - DNA, 1973 bp, Glycine max
  Predicted polypeptide sequence is orthologous to G2140
cgtcagctcggaattcggctcgaggcaaaatattcttatataaatagccttggagtttgtattatccttcaatagagttagtttcatatataaaacaggaagcaacaactgcaacagcagctatagaccctagggaaatgatacaggaagatcaaggacagtgttcttctcaagcgatcaataactaccaccaagcctatcaagagcagcttctccttcagcaacagatgcagcagcagcagcaacaacaacaacaaaacaatgatatctttggtggaggattgaacatgtaccctggtggtgaagtttctcaaatcatgcatcatcatcatcatcaaccatggtctatgactatgcctcatcaccatcatcatcatcatcaggttcatgacccttttcttgtccctccccaaacttcaccctatgcaagcttgttcaacagaaggggtccttctcttcagtttgcatatgatcatggttcatcttctgaccatcttaggatcatatctgaatcctttgttggaccggtggttcaacccggttcagcaccctttggcctccaaaccgagttggctaagatgactgctcaagaaatcatggaggctaaggcccttgcagcttccaagagtcacagtgaagctgaaaggagacgcagggagagaatcaataaccatcttgctaagctgcgcagcttgttgcctagcacaaccaaaacagataaagcatcattgctagcagaagtgatccagcatgtgaaggagctgaagcgtcaaacctctctgatagcagaaacgagtccggttccaacagaagctgatgagttaacagtagtggacgaagctgatgaagatggaaactcagtgatcaaagcctctttgtgctgcgaagataggtcagatctgttccctgaactcatcaagaccttgaaagcgttgaggctaagaacgcttaaggctgagataacaacgcttggtgggcgcgtcaagaacgtattgttcatcactggagaagaaacagactcatcaagcagtgaggaccatagccagcaacaacaacagtgctgcattagctcaatacaagaagcgcttaaggctgtgatggagaagagcgttggggatcatcatgagtctgcttctgcgaatattaagaggcaaaggaccaatataatatcaatgtcctaggaacggatcgaggtctttatgaattttatttaattaaaggcctatatatgcatgatcattattattattattactatctactaattaattagttgttatataagcatatatatatattttgattttgatttgcatattttttggggggtgtggtttggcttttacttttttttcttttcttgttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaaaaaggggggcccccccccctttggacctctgcccccgggaattatattccggccgggaccctggggggtccccttttttccttttggggggcctttttaaaactgggggaaacccgggcaaaaactggttcccggggggaaatggttatcggttaaaatttccacaaaaaaattggccggaaataaaaaagggaaaccccgggggggcccctggggggccccaccccaataaaatggggtgcccccccgggcccttttcaaaggggaaaccctgtctggccgttttttttataaaccgccaaccccgcgggaagaaggggtttttatcgggccccccgggggttctttttttccccgggaaaccgggaaaccttaatgcccttaaccccctggccctgaagagatgggaaagggggcccccttttttttcccccacagggaaaaaaccctttctgggggggggcaaacgggggaaataacaaagtt

SEQ ID NO: 1886 - DNA, 1491 bp, Glycine max
  Predicted polypeptide sequence is orthologous to G2140
  misc_feature (26)..(26): n is a, c, g, or t
  misc_feature (31)..(31): n is a, c, g, or t
gtacgcccatgcaggttatccggatnccggnaaattcccggggtcgacccacgcgtcctataaaataggaagcaacaacagcaacagcagcagctatagaccctagggaaatgatacaggaagatcaaggacagtgttcttctcaagcgatcaataactaccaccaagcctatcaagagcagcttctccttcagcaacagatgcaacaacaacaacaaaacaatgatatctttggtggaggaggaggattgaacatgtaccctggtgctgaagtttctccaatcatgaatcatcatcatcaaccatggtctatgactatgccacatcatcatcaccatcatcaggttcatgacccttttcttgtccctccccaaccttcaccctatgcaagcttgttcaacagaagaggtccttctcttcatcagtttgcatatgatcatcatggttcatcttctgaccatcttaggatcatatctgaatcccttgttggaccggtggttcaacccggttcagcagtaccctttggcctccaaaccgagttggctaagatgactgctcaagaaatcatggaggctaaggcccttgcagcttcgaagagtcacagtgaagctgaaaggagacgcagggagagaatcaataaccatcttgctaagctgcgcagcttgttgcctagcacaaccaaaacagataaagcatcattgctagcagaagtgatccagcatgtgaaggagctgaagcgtcaaacctcgctgatagcagaaacgagtccggttccaacagaagctgatgagttaacagtagtggacgaagctgatgaagatggaaactcagtgatcaaagcctctttgtgctgcgaagataggtcagatctgttccctgaactcatcaagaccttgaaagcgttgaggctaagaacgcttaaggctgagataacaacgcttggtgggcgcgtcaagaacgtattgttcatcactggagaagaaacagactcatcaagcagtgaggaccatagccagcaacaacaacagtgctgcattagctcaatacaagaagcgcttaaggctgtgatggagaagagcgttggggatcatcatgagtctgcttcggcgaatattaagaggcaaaggaccaatataatatcaatgtcctaggaacggatcgaggtctttatgaattttatttaattaaaggcctatatatgcatgatcattattattattattactatctactaattaattagttgttatataagcatatatatatattttgattttgatttgcatattttttggggggtgtggtttggcttttacttttttttcttttcttgttaatggtgtgcgctggcaaatgttgttactttatatgtattctccatcaacatcatcatcggtataagaaatgaggaaatgagagtttgggggggttttttgttaaaaaaaaaaaaaaaaaaaaaaaaaaaaaaaaaaaaaaaaaaaaaaaaaaaag

SEQ ID NO: 1887 - DNA, 1027 bp, Glycine max
  Predicted polypeptide sequence is orthologous to G2140
  misc_feature (13)..(14): n is a, c, g, or t
ttaacaactttcnnacagcatcttacacaaaggctttgctttcttcatatgtcatgaactacttatcccagaaccccaaagttgttattattcacgggaagagaattcgtgactgaagaactttttgactaccaaggtacaatatggtagaaagagtccactaattctgtctatggtcaaaagagtaaagttgctatctgtgactgtgaatgctcccaagacatgtacaaacccagattctgattcacatgattagtacaaactttccctaacaagtgaaaaggctatttgctaatgccactcactcactccctcttcatattcagatatatgccatgcatatggattatggagatttaaattacatatttaagaagaaaagttctcaaaagaaatctcctatagatgaagaactgaatatagaaatcctccttctcttcctgctttctaacatgtcctgtgaaacagaaaatctatctaacactgatcttagagcttgatgaacagaccctgccagaaactggcggtactcgggatcttcaatattttgttctttgcagctaattatcacaaacacactattcatccttcctcccaaggttgcaatctcagcccttattatcataagatgaagtgcatcaagtgcttgtcttatatcggccaataacccgggtttgtattcacaacatagtgatgccttgattgagtaagggaaaccattcaatccaccctcctgttcttcaactcttatttcatcactgtccttcggtatcattaggccttcactagcttgtgtcgcattcgttttcagctctttcaaatgtctaataacctcacccagcaaggttgctttgtccaacttcttagcaccaggaatgacagagcgaagtgtatcaagatgtgcattaattcttgctctccttctcctctctgcctcactatggttcttcaaggcttcaatgcttctctcaggagacacacccttgcgttccaatttgacaggggcctctacaagctctcccttctc

SEQ ID NO: 1888 - DNA, 1421 bp, Glycine max
  Predicted polypeptide sequence is orthologous to G2140
aaatccaaaacagctttaatttgccagcttagtaagacaaatagtacattctctcacaaactttttttaacacaacttttattatgggataagcggggctctcattatatgagggcacatatgctatttaacgaatctcatttattgttcagggagattcacccaataatagaaaacatattaaacaatatactatcagttgtgttgttagcattcctcaaaaaataagaaatgttaataccacactctaacacttgcagcagaaacagataacataacacatcaaattcttgacatcagcacaaacaaaacccatggttgcatgtggaattggatgtttcaataaagcatagtcttctcctcttgcttgcatgtgatgttcttggtgagaaatccagggaggcagaagccttttccatcacagaacatagtgcctggtgaacagtacttgcaagagcttggcatttttcaaaatcaatattattaatgttttctttgcaacaagtgaagacaaacacattcttcatcctacctgccaaagttgaaatttctgccttgactagatgcagtggaagggaatcaagggtctgtcttaggtcagatagtatttcaggtctgaaatcacagcagatagttgcactgtaagacatggatccttctcctccctcatgatcattatatggttcaactttcacttcatcagcatcctttggaatcagaaaacccttgcttacttccgctgcatttttcttcaactccttcacttggctaatcacttcagccagtaaagtggctttatccatcttttcagtggatggcacaaggccacgtagtgttgcaagatgaccgtttattctctccctcctcctcctctctgcttcactgtggttcttcaaagcagccaaagctttggcctcacaaatctcactcttccctacctttgcagctgcaaggcacttcaccagctctcccttatcactctcaaataccaaagaatgtggtgatgatgaccagtcattgcaagcgccattgcaagctccaaggttatgcaaagtaggattgaacaaccccgaaatatcggagccagaagaagaagaggttttgtcatagaaggagtaaaccatagtcctaaaggttttaaattgcagtcgtccttgcggttttattttgatccttgatgttgtaaaaaaattgccaacaaatacagccgatgcaaccacagttacaatcacgatgggcccttagaccttgacttatgtagtggaaattgcggtcgtggacttaaaacctttcaaacttttttagtggagtggagctacaagagaaagataagaaggaaattaacccggtggacaagttcgagttgcgaaccagaaagaaagcttttggaagtggatggtgccttgtgaaactgctacgtt

SEQ ID NO: 1889 - DNA, 382 bp, Glycine max
  Predicted polypeptide sequence is orthologous to G2140
agctcagccgagctgttttatgcataacacacgaggctcttcttatatcaggatgcctatgaccatcaaggctcatgttctgaccatcttaggatcagatctgaatcccttgctggaccatcggaacaacccggctcaacagtaccctttggcctccaagaccgagttggctaagatgactgctcaagaaatcatggaggctaatgcccttgcagcttcgaagagtcacagtgaagctgaaaggagacgcatggagagaatcaataaccatcttgctaagctccgcagcttgttgcctagcacaaccaatacagataaagcatcattgctagcagaagtgattcaacatgtgaacgagctgaagcgtcaaacctcggtgata

SEQ ID NO: 1890 - DNA, 501 bp, Glycine max
  Predicted polypeptide sequence is orthologous to G2140
atgagggctaatgttcccacctgaagtctctccaaccttgcaacaacaatcatgggccatgcctccggttcactccttcaactccaacccggttcactacatcaacaacaacaacacaaacccggttcatcatcatcatgagcaagcaccatttcttgtccctcctcccacaacaccttcaccctatgcaagcttcttcagcagcagaagggttgtcccttctcttcagtttgcatacgagggtccctcttctcatcttgatcaccaccaccatctgaggatcatttctgacacccttggacccatggttcaacccggttcagcagcaccctttggactccaagccgagctgggaaagatgactgctcaagacatcatggaggctaaggctcttgctgcttcaaagagccacagtgaagctgaaagaagacgtagagagagaatcacaaccattttgccaagcttcgcagtttgtttctaacaccaccaaaacagacaaag

SEQ ID NO: 1891 - DNA, 1019 bp, Oryza sativa
  Predicted polypeptide sequence is orthologous to G2140
agcgttcaatcgatcgatcgatccccgcggctcggtttgtgttgcgttcttccagatcgatttgatagatgggtgctcatggagaccaccgccaccaccaccaccatcaagaagccggggtgctcgtcgacgaggaggaggaggaggtgatcgagcaggcttgcggtggcccgacgagcggcgtggtggagcaagaggtggggggagacggtggtggagtgtgccaagatgctgccggcatggtgttcgaggcgaccagtagcgtcgggagcgtgagcgccaccatggggccgccgccgatcatgtgctggccaccgccggcgcagcctgtccacggtgcaatccaccaccaccacaacctaggcggcggcggcggccagcagagcccgttcttcccgctgctgccgccctgccccctcagcccccgccgcacccccgttcttcgccgacttctacgcgcggcgggcgctccagtacgcgtacgaccactccggcggcgcgtcgtcgtcgtccgacccgctcggcctcggcgggctctacatgggtcaccacggctcccacgtcgccggcatgatgatgccgccgcccttcgctccgtcgccgttcggcgacctcggccggatgaccgcgcaggagatcatggacgccaaggcgctggccgcgtccaagagccacagcgaggccgagcgccgccgccgcgagcggatcaacgcgcacctcgcccgcctccgcagcctcctccccaacacaaccaagacggacaaggcgtcgctgctcgcggaggtgatccagcacgtcaaggagctgaagcggcagacgtcggagatcacggaggaggcgtgcccgctccccaccgagtcggacgagctcaccgtcgacgcgtcgagcgacggaggacgggcgcctcgtcgtgcgcgcgtcgctctgctgcgacgaccgcaccgacctcctgccggacctcatccgcgcgctcaaggcgctccggctgcgcgcgctcaaggccgagatcaccacactcg

SEQ ID NO: 1892 - DNA, 592 bp, Oryza sativa
  Predicted polypeptide sequence is orthologous to G2140
  misc_feature (544)..(544): n is a, c, g, or t
  misc_feature (584)..(584): n is a, c, g, or t
  misc_feature (591)..(591): n is a, c, g, or t
accaattatcatgtacatgaagtgatcaaatctcacccacaagcatatctctcgcaccattccaccctatagaaacgagataacaagacgctgtttgcactagctatttgacagccgacaagaaccagttaggtaaaactcagtaggatgcaggtttgaatggctgaatgccaacctctgcaactgcaagaaggcaagaaactgcaagagctgcagccatacgatggctgcaatccttcagtgtacagaggcccaattctgctgccccggcaggccaactcggcgccgccggccgtgccgccggagatgtcgtcctcgtcggggtcagggagaagcgcgacggaggcgagagcgttgaagatccacagcgaggctgaacggcggcggcgagagaggatcaatgctcatctgacaacactgaggagaatgatccctgatactaagcagatggacaagggccaccttgttagccagagtggtggaccaagtgaagggtctgaagagggaaagcaagtgagatcacaccaaagaacacctcttcctncagagaaccaacggaattcttccatcgatgcttcaccggngacgctng

SEQ ID NO: 1893 - DNA, 565 bp, Oryza sativa
  Predicted polypeptide sequence is orthologous to G2140
gcacgaggagaaataatcgaacctcatatagcattattgagttaatcgtcattaattcatataggtggggattttggatagatggctgcatgccagcagcagatttggcaagaagggaagcagcagcagcatctgcaccacggtggctatgatgatctttcttcagtgtacagaggcacggttgtgctgccacggcggcagggcggcctggcgcgggagccgccgccgccgcggccgtcatcgtcgtcggggaggagcgcggcggctcaggcgacggcgatgaggatccacagcgaggctgagaggcggcggcgggagaggattaatgctcacctggctacactgaggaggatactccctgatgctaagcagatggacaaggccaccttgctagccagcgtggtgaaccaagtgaagcacctcaagacgagagccaccgaggccaccacgccgtcgacggcggcgaccatcccaccggaggccaacgaggtgaccgtccaatgctacgccggcggcgagcacaccgcggccgcgcgcacctacgtccgcgccaccgtcagctgcg

SEQ ID NO: 1894 - DNA, 548 bp, Oryza sativa
  Predicted polypeptide sequence is orthologous to G2140
ctgcttgctgcatcatttcttgacaactgcagtgttcttgatgctgttgcttcatctgatccatctcattttccccgtgttactgcagtgacagccgacaagaaccagttaggtaaaactcagtaggatgcaggtttgaatggctgaatgccaacctctgcaactgcaagaaggcaagaaactgcaagagctgcaggcatacgatggctgcaatccttcagtgtacagaggcccaattctgctgccccggcaggccaactcggcgccgccggccgtgccgccggagatgtcgtcctcgtcggggtcagggagaagcgcgacggaggcgagagcgttgaagatccacagcgaggctgaacggcggcggcgagagaggatcaatgctcatctgacaacactgaggagaatgatccctgatactaagcagatggacaaggccaccttgttagccagagtggtggaccaagtgaaggatctgaagaggaaagcaagtgagatcacacaaagaacacctctccctccagagaccaacgaagtctccatcgaat

SEQ ID NO: 1895 - DNA, 1769 bp, Zea mays
  Predicted polypeptide sequence is orthologous to G2140
  misc_feature (45)..(45): n is a, c, g, or t
ggccgctttttttttttttttttaaacccagcaagcaacataganaatgtgcaacgagcagtagtccttatccctctacgtcaatcgcagggaaaacaatctcaagtcagacaagaacccgcccgcctcgcaagacacatacatatattctccctcgctctcaaacccttttccactcacgaagagcagagctgttgctagagctggtcgtcttcctcttcctcttcctcctcctgcctcgatctgacgagagctcagccttgccttagtctcgccatcgcagaaggcagaagcactagttcctgacagccacaaaaccaaccaaaggccaagctaccgtgaggcgagggaaagggaaagatcacatatcgcctattcgcctacctctgcgtgcatcagaagatgatccccttcataaagatgaaacattcccattccctccactagaagctccgggaggacgcagcaagctcaccgaagccagcaaccgatggatcagaggcgcgtcacggcgaggttcggcagcaagacgagctcggagcggaggatgctgcggcgagtgaggctccccttctggtcctgccctccaaaccggcctccaggcacctgagcgcctcaaatcctcgatagaacagctggtctcgtgctcccctcccccctgtctctctactctgactttctttctttctttctccgctccgctccccgtgcccctcctgctccttggaccctgcctgttctgtcagtcagtctccctccctagaacggcatggctctgcgttttgtgtgatctcgtcgcgagcctgtccgccggtgccggtgcctcaatccccttgggagaagcaagggctcctgtctggtccgtgttcttgggaaccagggccttggtactgctgctgccgcgtgcttcactgcttcctggctgctccgatcctctcgtctcgtgtgtgaaagaaacattccggagcccacgcgtccgcccacgcgtccgccgcaacttgctggatgcaagagctgccctgtccctgccctgagcccctgtttccatcggaaaaggcaacagctcttgcgtgcttggcacctgccgagtaattcgttatatatacagtgctcccacgaagcactagttggcagctgctgcgctgttatgttcttgtgcctcgtggatcgtccccgtcggcctcgaagctttccacgacgaaatggacgacatgggctccgtccccttcgccgacgccgggctcctcgacgggttctacggcggtagccatggacatggtggtgactacgagctgctcgctagccagctgggagcgggagcgtcgtcgacgtcgcctgccatcttagacggcagcgtgccgctggtcgacgccgcggcctccgcggaggaggcgacgaggagtaagggagaccacctccaggatgacaaggcggcgatggcgctcaagagccacagcgaggcggagcggcgccggagggagaggatcaacgcgcacctcgccacgctccggaccatggtgccctgctccgacaagatggacaaggccgcggtggttggctgaggtgataacccacgtgaagaagctcaagtccaccgcggcgcacatccgagaccgctgcgccgccgtcccggccgacgcggacgacgtcgtcgtcgagctggtccatggcggcgcggcgccgccgtcggccggaggcggcgtcctcgtcagggcgacgctcagctgcgacgacggcgcagacgtgttcgcggacgtcaggcacgcgct

SEQ ID NO: 1896 - DNA, 500 bp, Lycopersicon esculentum
  Predicted polypeptide sequence is orthologous to G2140
accaggcagcttccaagagtcacagtgaagctgaaaggagacgcagggagagaatcaataaccatcttgctaagctgcgcagcttgttgcctagcacaaccaaaacagataaagcatcattgctagcagaagtgatccagcatgtgaaggagctgaagcgtcaaacctcactgatagcagaaacgagtccggttccaacagaagctgatgagttaacagtagtggacgaagctgatgaagatggaaactcagtgatcaaagcctctttgtgctgcgaagataggtcagatctgttccctgaactcatcaagaccttgaaagcgttgaggctaagaacgcttaaggctgagataacaacgcttggtgggcgcgtcaagaacgtattgttcatcactggagaagaaacagactcatcaagcagtgaggaccatagccagcaacaacaacagtgctgcattagctcaatacaagaagcgcttaaggctgtgatggagaagagc

SEQ ID NO: 1897 - protein, 223 aa, Oryza sativa
  Orthologous to G2140
MVTDGECSAAAVRKGGSPAVRSHSEAERKRRQRINAHLATLRTLVPSASRMDKAALLGEVVRHVRELRCRADDATEGADVVVPGEGDEVGVEDEDDDEGERDEGCYVVGGGDRRWRRRVRAWVCCADRPGLMSDLGRAVRSVSARPVRAEVATVGGRTRSVLELDVVVASDAADNDRAVALSALRAALRTVLLNREELLAAAAAAATDGYKRPRFSPRCSSLT

SEQ ID NO: 1898 - protein, 267 aa, Oryza sativa
  Orthologous to G2140
MGSAPFGDAVAGGGLYEYQGYHGGFAGGHGLGQPAGRAPALDDGETEGMDASAAAAVAAMEMAKRNCGGGREEKAAMALKSHSEAERRRRERINAHLATLRTMVPCTDKMDKAALLAEVVGHVKKLKSAAARVGRRATVPSGADEVAVDEASATGGGGEGPLLLRATLSCDDRADLFVDVKRALQPLGLEVVGSEVTTLGGRVRLAFLVSCGSRGGAAAAAMASVRHALQSVLDKASSGFDFAPRAASLLGSKRRKVSTFESSSSSS

SEQ ID NO: 1899 - protein, 363 aa, Oryza sativa
  Orthologous to G2140
MWEGGSHDAAAQLLPWFVGEPAAAAVGGYGGCVDVVGQGGVFGFGFEAAAAPVVTRQQRGGAAAAEGSSRGGGGKPAVVSGLLGSLQAELGRVTAREIMDAKALAASRSHSEAERRRRQRINGHLARLRSLLPNTTKTDKASLLAEVIEHVKELKRQTTAIAAAAAAGDYHGNDEDDDDAVVGRRSAAAQQLLPTEADELAVDAAVDAEGKLVVRASLCCEDRPDLIPDIARALAALRLRARRAEITTLGGRVRSVLLITADEQQQQHCDDVDDDEDGHRLLLRHGIDGAGAAADDDDECAASHRRHECIATVQEALRGVMDRRAAASSGDTSSSGGAVVAGGGGGSIKRQRMNYGVHEQCSV

SEQ ID NO: 1900 - protein, 209 aa, Oryza sativa
  Orthologous to G2140
MSSSSGSGRSATEARALKIHSEAERRRRERINAHLTTLRRMIPDTKQMDKATLLARVVDQVKDLKRKASEITQRTPLPPETNEVSIECFTGDAATAATTVAGNHKTLYIKASISCDDRPDLIAGITHAFHGLRLRTVRAEMTSLGGRVQHVFILCREEGIAGGVSLKSLKEAVRQALAKVASPELVYGSSHFQSKRQRILESHCSIMSI

SEQ ID NO: 1901 - protein, 323 aa, Oryza sativa
  Orthologous to G2140
MGAHGDHRHHHHHQEAGVLVDEEEEEVIEQACGGPTSGVVEQEVGGDGGGVCQDAAGMVFEATSSVGSVSATMGPPPIMCWPPPAQPVHGAIHHHHNLGGGGGQQSPFFPLLPPLPPQPPPPPPFFADFYARRALQYAYDHSGGASSSSDPLGLGGLYMGHHGSHVAGMMMPPPFAPSPFGDLGRMTAQEIMDAKALAASKSHSEAERRRRERINAHLARLRSLLPNTTKTDKASLLAEVIQHVKELKRQTSEITEEACPLPTESDELTVDASSDEDGRLVVRASLCCDDRTDLLPDLIRALKALRLRALKAEITTLGGRVKN

SEQ ID NO: 1902 - DNA, 504 bp, Glycine max
  Predicted polypeptide sequence is orthologous to G2143
gccaccacccaccactttgattaatccaccaccaccttcctccaatttcgttctacaacaacccatgacacctcatcttgaacccaacccggagaagaagaattctgtggcggctatgagggagatgattttccgtgtagcagtgatgcaacctgttcatatagacccggaatccatcaagccaccgaagagaaggaacgtgaagatttcgaaggatcctcagagtgtggcggcgagacacagaagagaaaggataagcgagagaataaggatccttcagagattagttcccggtgggaccaaaatggacacggcttctatgttggatgaggccatacactacgtgaagttcttgaagaaacaagtgcagacgctggaacaagcaggggcaactagacccttgaatgttgttggcttccctactactgtgtccaacgccaataataatgttaattattctagttttgtgaagagttgccaaccttatccaatgctgggttcttc

SEQ ID NO: 1903 - DNA, 518 bp, Glycine max
  Predicted polypeptide sequence is orthologous to G2143
cccatactctctgctcctaactttttctctcttctcccctttcttccattcctccttgtctctcgcaacgcgaaattcatggacgtggacatactgaaaacttccacgagtgacaacatcagcatggacatgatgatgacgatgatgcaaatggaaaagttccctgaattttgtgaacctttttataacaacaacaacccatgacaccccatcttgaacccaacttggagaagaggaattctgtggcggctatgagggagatgattctccgcgtagcagtgatgcaacctattcatatagaccctgaatccatcaagccaccgaagagaaggaacgtgaagatttcaaaagatccgcagagtgtggcggcgaggcacagaagagaaaggataagcgagagaataaggatacttcagagattagttcctggtgggaccaaaatggacacggcttctatgttggatgaagccattcactacgtgaagttcttgaagaagcaagtgcacacgctgggacaa

SEQ ID NO: 1904 - DNA, 1146 bp, Glycine max
  Predicted polypeptide sequence is orthologous to G2144
gaacaaagcaacaaacttcaatgatagttcagtaatagttcgttcaatgattttacaatctaaatcaatcaatcacttgaaagattgaatgattactatagttagtatacatagtgatagtaatatattaaataaaaatagcataccaattcttcttccttgctggctgaataaaatccaggtttccaactgactctgacaaaatagagttagggaaaacctgctgaatgttgaggctgctcaaatcatgactaattgctaatactatatttgttatatacactaataggctaattgctactggtaccaccacctttgtagtttccctttagagctccatcttcaactgatttgaatgcagagatactgaatttgccgatgagtcataactcaagagtgagttttctggagtcatgaaattagtgttgtcttcttccctcccccaaaggggttggtggagtgcatcaaacggccatggttgctgatattgttgtctgtttccgttctgtgggatttctggccacatgacaggtgcaactgtcggagggaagttacagtccattggagtcactccttcagtagccagtaagctgtcgaggttgaaatcaattactgggttaactgctgccagtttcattgataatatctccacttcattctgtagagattgcacatggttgatgattttatccagaaccaatgccgttcccgatatcttgttgcaacccgggaccagctcttgtaaaagcttcatccgagcatttatcttctctctcctagccctttctgctaagctatggctatcagtggcttgacctcgacgaactcgaacgtgaacgtacggaagcttctcgccgtcgccggaaatctcgtcggcggcggcgacgctcttgctcttcttcgacgacgctttaaccttcttctctcgctccttcctcttcgcagttttcagattctggttctccacggcgagatcggagacggagcctccgccgccgccgccgtgagtggagctcgggttggaatcggtctccggcagctctcgcttcacctccggcgagttcgagttcgagctctggccggcgaagacggagaacctggcggcgcgatcgatcagcgcggcgttggagggaaaggtgaggttgc

SEQ ID NO: 1905 - DNA, 1563 bp, Glycine max
  Predicted polypeptide sequence is orthologous to G2144
atactatatttgatatatacactactaggctaatagctactggtacgacttctgtacgctttcagagctccatcttcaattgatttgagtgcagagaagctgagtttgccgacgagtcataactcaaaagtgagttttccggagtcatgaaattatggttgacttcttccctctcccagagaggttggtggaatgcatccaattgccactgctgttgataatgctgccggttgccattgagtgggatttctggccacatgagaggtgtcaccatgctaggtaagttattatccattagagatgccccatcagtagccaataaactgtcgaggctgaaatcaattctagggttaactgctgccagtttcattgataagatctccacttgacgctgtagagattgcacatggttgatgatttcatccagaaccattgccgtccctgatatcttgtcgcagcctgggaccagctcttgcaaaagcttcatgcgagcgttgatcttctctctcctagccctttctgccaagctatggctatcagtggcttgacctcgacgaactcgaacatgaacgtaaggaagcttctcgccgtcaccggaggtctcatcggcgatgcttttactcttcttcgacgatcctttaactgttagcttcttctctcgctcctttctcttggcggtcctctgattgttgttctccaccgcgggatccgaaatgcaacccagcctcgagctcgagcacgggttcgaatcggtctcctgtggctcgttcttcactctatccaaattcgaaacggaaccggtcccggccggaaccaggcacgcctcctccggcggaagcggcgagttctcgccggcgaacacagagaacttcgcggcgcgttcgattaaggcggcgttggaagggaaggtcaaattgctgccgaaagaattgagcaggtagggtttctggttcgcgctgacatggcaattaggcggtttccgagcgctgtcagattccggcgagtgaaggagctccaccgcctgcgtcggcgggagttcaagcagcgcggtgaacgagctcgcgttttccggagctggcaccggcgccatgattccctgaatttcttcgttgaattgaattgactcgagcgtagcgccgtcatgcacggatccgcgcaatcctcccggagcttggtccattgagcgaacaaaacgcagcgtagaaggtccaattgaaccgtacacacctcaaattttgtctttacttggacgaattctgaaccgtgacagtgttgaaattggagaaaatgaggaaatgaagaatgtgtgtggggaatttcgttacgagtggagtgagagatagaagaagcaaagcttcaatggcggtcaatgaaattcatctctctctttctttctctttctctccggttctgtgattctgtctctgagattgcttctcggccatttgaagtactgcgaaagcaacgatgctacgctacggttactctactactgttgaatcatacgagtacggttccagccatacagtttcgttgaggtaaggttaaagggtaggttgggac

SEQ ID NO: 1906 - DNA, 1709 bp, Zea mays
  Predicted polypeptide sequence is orthologous to G2144
  misc_feature (384)..(384): n is a, c, g, or t
  misc_feature (409)..(409): n is a, c, g, or t
cgggctctccctaggtccctacctctccaatcttctccttccttgaccccagcggaggaggagccagggcgtgcgagtgcgaactgcgaacgcagcagcagcagctcacgcgcgcacggcacaccagtgagtgacaccacctctcgcctcagcgccgcccccctataaataatggcgccactctcccctacccccgcctccgctcccgtgtcctcctcccctcgttcccttgtcccggacgcctccgccgagccgatgcgccgcgcctcgccgccgcaggagctccccgtcgccaggggcgagatccaggcggcgctggcccccgccaatgcctcctccgcgggcgcccacggaggcggaggctccttcccggcgctgctgggnactccccacctcgcgggccggggangctgctcctcccccgcacgacgccccccgccctagccacagcgcccgcgccaaccttcccctccgacccgcacctcgtggaccgcgccgcgcgcttatccacgttcgcgcccccgtccccgtccccatcctccacgggggcgggccggcccctccccgccgccgctaacgccggcaagcgcaaggccgaccccgtcgaccgtgcctccaaggggaaggcggcgaagaaggggaagacggcggaggagaagctcgcgggcggcgacggcgacgacgagaagccggcgtacgtgcacgtgcgggccaggcggggccaggccacggacagcctccgcctcgagcaaaaaaccactcatcaggcgagacgcgagaagatcaatgcgaggatggagctgctcaaggagctggtccccggctgcagtaaggtatcaggaacagcgttggtgctagatgagatcatcaatcatgttcagtctctccaaaggcaagttgagtacttgtcaatgaggcttgcaactgtaaacccgaggggcgattttggtgggctagacagctttctgaccacggagtgtggaaggatagcaagcttcaactgcaagaacggaatcgacttggagcaggtaacctggccagaaatgggtgttcatggagcaaggcagctgatgcaactccaacagcagttctggcatggcgatttggcgcatccacaccaagtggcttcacagtgggaaaagcggggggatggccatcctcccgtcttcagcaactccagtccctctctcttcggctatgatctaacaagctctggagcccagcaaaacccggcgagcaagctaaagaccgagctttgatcgacaacggtaaatagcatgtcaggggagcaagatggacatatggggggagggggacacagaatttcagcaaattgatcaaggcacaaacgagctgcgaatgaatgatggctgtggatggttgatgtcaagcccagcgaaatcaacattttcagagaggggatgtacatatagcgatagagatactgttggtgttgagctgaagacggggatgcatatgatgggcgaggataccgcagtcgttggagagacaggcaagccctgttgctatcgttgcagagatggccaagcgataccctggtttcgttactgatgatgatgacattcttagtgtatttctgacgactataatggcagtcttaaggttatatgggcagcattttttacgaacgcaagacatttcaacaagcattggaaaatttggcaacccaaaaaaaaaagggcggccgc

SEQ ID NO: 1907 - DNA, 1219 bp, Zea mays
  Predicted polypeptide sequence is orthologous to G2144
cccccctgggtcgacccagcgtccgcgccaaccttcccctccgacccgcacctcgtggaccgcgccgcgcgcttatccacgttcgcgcccccgtccccgtccccatcctccacgtccccggccccgcccctccccgccgccgctaacgccggcaagcgcaaggccgacgagaagccggcgtacgtgcacgtgcgggccaggcggggccaggccacggacagccacagcctcgccgagcgggcgagacgcgagaagatcaatgcgaggatggagctgctcaaggagctggtccccggctgcagtaaggtatcaggaacagcattggtgctagatgagatcatcaatcatgttcagtctctccaaaggcaagttgagtgtggaaggatagcaggcttcaactgcaggaacggaatcgacttggagcaggtaacctggccagaaatgggtgttcatggagcaaggcagctgatgcaactccaacagcagttctggcatggcgatttggcgcatccacaccaagtggcttcacagtgggaaaagcggggggatggccatcctcccgtcttcagcaactccagtccctctctcttcggctatgatctaacaagctctggtgcccagcaaaccccggcgcgcagtcctatatcaccttcctgaatgaatttagttgtttgtcgcttacttcacatatcacagcctggcttgccccacaacttttgtctcttagtttgtcccgccagtgctctcttgagaacaaagtgtactgataggtaaatttaaaaatttgctgtccaaaacctgaggtgaatattttctactatctaggggaagtttctgaagtatacaaagctatttatagtcatggccaaatcttgaatatgctagcatagtagcattgctgttatattggcccagatagcaaatagacacagaaacacaggtgaagcaaaagacatacagaagcatgtggcagtacagtgaccaagtgttttgcattagctaataaacgtgatagagagccagagatcccaactaggagtccctctgtttgcttatggaatttggaaacaacacagatatctaatttgagttgccgcgccctttttcagaggaaaacttctatttccactgcttcagaactatcagcattatccacttttcatactaacaaaaaccatgagcccaggacttcgctagaaagattagcagattagagtgt

SEQ ID NO: 1908 - DNA, 714 bp, Medicago truncatula
  Predicted polypeptide sequence is orthologous to G2155
ctcacagagatatcacaacaaaggaccaaaaatgttctcaaactttcaacaacaacaacatcataacctatttcaaccttcacgtgaatgccaaacctcagaagaagatgaaacccgaagcagcggtgggcccagcccaaacaaaccttcctgtaacgacggcgccaccattgaaattggtcgtaggccaagaggccgtccacctggctccaaaaacaagcctaaagcccaatcacaaatcataatcaatcactcctccgaccctgccatgagcccacacattctcgaaatcccagaaggcagcgacgtcgttgaagcaatatcccggttcagtaacagaagaaaaaccggtttatgtgtattaaccggttcaggcactgtagctaacgttacactccgtcaaccttctggtcctcctggcaccaccgttacttttcatggtcgtttcaacattctttcaatctccgccacgttcttctctccgttagaatcctcaccacccatgaacaaagaattctcaatctcactcgccgcacctcagggtcagatcgttggagggtttgtcgtcggtccgttgcttgccgccggtacggtgtttgtcattgctgcttcctttaacaatccttcttatcatagattacctttggaagaggatgtgaggaataactcagtctccggcggctatgaagagaagtcgccggcgcagctttctgg

SEQ ID NO: 1909 - DNA, 824 bp, Medicago truncatula
  Predicted polypeptide sequence is orthologous to G2155
tcacccttttcaactttctcatcatgaatgtcaaccaatcggtgaagatgataacaacaaccaccagcggcggcgttgctaccactcagaaacctaacacctccggcgacggtgcaactatcgaggtttctagacggccgagaggacgtccacctggctcaaaaaacaaaccaaaaccacctattatcatcacaagggatccagaaactgtgatgagtccttttattctagatatttctggtggaaatgatgttgttgaagctatttcagagtttagtcgtcgtaagaatattggtttatgtgttttaactggttcaggaactgttgctaatgttactcttcgtcaaccttcaactacaccaggaaccaccgttacttttcacggccgttttgatattctttctataactgccacttttgttcctcaacaacacggtgtttctccggcgattccgagtaacttctcgatctctcttgctggacctcaaggacagattgttggaggaattgttgctggaaatttgatagctgcagggacggtgtttgtgattgcttcttcgttaataatccgtcgatcataggttgccgttggaagaagatgaaggtggaaactcggtgtctggtggtggtgaaggaaactcgcagaatgtttccggtgcggtggacagtggacaagtcagggtggtgggtggtgagtcctgtgggatgttcgatgtacaactgtcatttgccgtcgtcggatgtgatttgggctccgtctgctagacccccaccaccttactgatatcatcatcattcacattttcataaacctttgttgcaaa

SEQ ID NO: 1910 - DNA, 573 bp, Glycine max
  Predicted polypeptide sequence is orthologous to G2155
cagcaacaacatcctaagagtgaaacaccacctagtatgttctcaaagcttcagcctcagcaccatcctttcccgcaccaccctttccaactctccgccgaggatgccaccaccatcaccccgagcaccgctcagaaggccaactcctccggcggcgacggcgcgaccatcgaggttgttcggcgtcccaggggacgtccgcccgggtccaaaaacaagcccaagccaccggttatcataacccgtgacccggaacccgctatgagtccctacattttagaagtgtctggcggaaacgacgtcgtcgaggccatcgcgcagttcagtcaccgcaagaacatgggaatctgcgtcctcacgggttctggaaccgtcgctaacgtcacgctccgtcaaccttccaccacgcccggcaccaccgttacttttcacggccgtttcgacatcctttctgtttccgccaccttccttccgcagcagtccggcgcttctccggcggttcccaacggattcgccatctcgctcgccggaccgcaggggcagatcgtcggaggacttgttgccggcgggctg

SEQ ID NO: 1911 - protein, 852 aa, Oryza sativa
  Orthologous to G2192
MDLFVAIALGLERMVRRNSDTTSKRVDQINSKWQFHLSIDDNTDSSCLFKERLTQALRYFKESTDQHLLVQVWAPVKSGDRYVLTTSGQPFVLDQQSIGLLQYRAVSMMYMFSVDGENAGELGLPGRVYKQKVPEWTPNVQYYSSTEYPRLNHAISYNVHGTVALPVFDPSVQNCIAVVELIMTSKKINYAGEVDKVCKALEAVNLKSTEILDHPNVQICNEGRQSALVEILEILTVVCEEHKLPLAQTWVPCKYRSVLAHGGGVKKSCLSFDGSCMGEVCMSTSDVAFHVIDAHMWGFRDACVEHHLQKGQGVSGKAFIYRRPCFSKDISQFCKLEYPLVHYARMFGLAGCFAICLQSMYTGDDDYILEFFLPPNCRNEDDQNALLESILARMKKCLRTLKVVGNGDTNEVCLQISNVLIIETEDLKTNVHFENSEGCFRESPESNGSQRVHEVDNDGNKVSIMSERHLLADDNSQNNGASVGRPNGSGASDSLHKSNKPPERRRGKAEKTISLDVLQQYFSGSLKNAAKSLGVCPTTMKRICRQHGISRWPSRKINKVNRSLSKLKQVIESVQGSDAAFNLTSITGPLPIPVGPSSDSQNLEKASPNKVAELSNLAVEGDRDSSLQKPIENDNLAILMSQQGFIDANNNLQLEADKASHSRSSSGEGSINSRTSEASCHGSPANQTFVCKPIASTFAEPQLIPEAFTKEPFQEPALPLSRMLIEDSGSSKDLKNLFTSAVDQPFLARSSNLALMQNSGTVTIKASFKEDIVRFRFPCSGSVTALKDEVAKRLRMDVGMFDIKYLDDDHEWVKLACNADLEECMEISGSHVIRLLVSDVAAHLGSSCGSSG

SEQ ID NO: 1912 - protein, 407 aa, Oryza sativa
  Orthologous to G2295
MARRKIPIGLIAHRQKRAATYAKRKESLRKKAEELSTLCGVRVAFVCAGPVVPGGGGGAAGKEEVWESEEGVLAEYRALPPEARAQHAHRVYLEEEVGKERAKLARVRQDGAFPSWDAALDGITADEARALLESIDAARAAANARREALGLPDDGNGVDDDGGLDLQQQQEHVPPGGSDAVVVPVGHGVLQYTGSGGGNQMQTTPAADGINCADLYGAVPWDDTFQPQVMRTGDHFVPMDGYLWQAPGNGWPDLATGCTNESCSCNAAAAAAAMPAMYPPTLDTVHGSFLAAPAQPIPIAFSTSTDFIDAPNDFLTMGLCGGFTNVGDYSAAQPQSSADGGFQLGDTFAAEPGDTQSQNWGSFINVVSDDSAQCNCNAAIHLDQMYYLFGGTGGGEPSDTQSRHWGS

SEQ ID NO: 1913 - DNA, 1657 bp, Glycine max
  Predicted polypeptide sequence is orthologous to G2340
aattcggctcgagctcgtgccaaagaggcttattgaacacttgcagcagctagagccacaatttcaatgcccctgattagtttgtctgtccatcacagtacatagtataataatcataaaccctttttctcagcgaggcacacagtatcattactacactttttttttcactccattgttttggcaagtcctcaacccccctccccccagcataaagagctataattcccttctcagccacaatatggctttgtaaaatgggaaggactccttgctgcagtcacgaggaattgagaaaaggggcatggacggttcaagaagaccagaaactaattacttacattcagaaacatggcacaggaagctggcgtaccttgccacagaaagcaggtcttaaaagatgtggaaagagttgcaggctgagatggtttaactaccttagacctgacattaagagagggaaattaagccaagaagaagagcagacaattatcaaacttcgggcggttcttggaaacaggtggtcaagtattgcaaagcacttacccatgcgaactgataacgaaatcaagaactattggaactcatatctgaaaaagcagttcgaaaagaatgctgtggatccctcaagttcaaaaccaaatagcactgatagttcctcagaatcaaaatctaatgacacgtgcatggttccatcagagaaaactgattgccatgaaccaaacaccagccaatctcatcagcacaacttatcaaggtcaatctcatcatcaactcatcttcttaacaaagttgctagtaaaattctggcatcagggtacctagaactaatcaaatcatgccaacctgttgttgctgggaacagcaaaagtgaaagtgtggttaaaactggtattgggttagaaagtgacaatattagagacccccttgagcctaatttgacctcaccaagtcattctataacttctgctaagttactgaacaagatggctacttccctccctcataaagttcatggccttgaagctgcaaaagctgtgttctcaaaactgatggaaaacagtgaaaaaggtgccactgctagtgatgatagctttgttggaggttgtttaaatgctttaagcccttttgaggataaaccacacataacaaaaacaattgactccccttctggtcctacactaatgttcaaccatgttaccacaccctcatgcttttcagaagataatgaagataactggcaatgcgtttcatctaactatgtttccttcaaaatttgtgctgcgaatggtggtgactgcagtgtctctgagatcaacttgggtgagtcttccagttccacatccagcttcctgtttgagaatgctgaccttggaacgtgtgatgatgagataagcaagtacatccagtattgtagggaaaaaaatttgtggacatccaatgctaataatgtaggtattacaaggccctatgatgtaagaggaagatatctaaagagagataatatatcctaatagagtgtttgatatatcaccatgtttatatagaggtgtttgacggaggaatttatgtatcatcactctatttgtaataagaaattatattcttccttataatttttttttactcaaaaaaaaaaaaaaaaaaaaaaaaaagg

SEQ ID NO: 1914 - DNA, 1535 bp, Glycine max
  Predicted polypeptide sequence is orthologous to G2343
ccattatttattctcattcaaaacccaccatttttacagtcaaaaaacaagcaaattgaagatgctttccatatatatcttcaaaatcaaactttccttcgggttacaatcgcctttattattattccttctcttttttttttccctcttccatgtcaaaacactcaataaagtaataaacacatcacgcttggttatatatataacatcttatcttcactcatttttggcaatctttgcaatcagcaatcgaaagaggtttgaaaaaaaataatcaaaagaagaaaaagcaatctctgcaatataagtttcagcctgggccggaccattcctgaaaactcttcctggttagagggagcatgagaaaaagagtatagtggggagtggggacagtccttgttgcagtcataaagaggaaggaaaaggtgaaagtgtattgtttcccatatttgacgtgtttggtgctagttcttcccctcgaagttgtccttcaacattaatattgtcccagaaaagaaagctgggacattgttgttgattctccacccactcattcaaatcttgtctccgcaaacactctagtgccatttctccttcctcgtctatactacaagactgtacttccatatttggcaccatgttttcaacgttctctatcaatggtggcagataattcgtagtatcaataacggttgctgctgtaaaagttgctgctagttgaggaggaagagcatggacttgatggtggctcatgttccacgtttcactactgctcaaacccaatgaatcttggaacagttctgctcgtacattattggtggtgtctacagttgttgtcccttgatctaatgaactagtgtcaaacataaatagggggcacgtcgaggaaaataaggtttcttgcaccggtggctttgctgttacattttcttggttgccatagtgatctagttgattggaattaaaattgaattggagctggtgatgatcaacactttgtgtagtggtgattgatgaagtcaccgtagaaggctttctaattttctttttgatccaagaattccaatagttctttatttcgttgtcagttctacctggtaagtggcttgcaatgtgagcccatctgttgccaacgaccccgtgaagacttataattaacttctcctcttcaggtgtaaacctgcctcttctaatatcaggcctcaaataattaatccatctcaggcgacaactcttaccacacctttgaagcccagctttctctggaacttcactccagcaaccatagccgtgagtggtgatgtatctgatgagcttctcatcttcctcgggggaccaaaggcctctcttaaccttctgttggttgcagcaagaatggtgacccatctttatttatttccttggtgccttgggccgggctcgggtcttcctcctccattcctgtcttttagtcttgttccctcagtggccttttattgcctggattaaatacggggatttgtatgccaatgcaatagttaagttaggtctctctc

SEQ ID NO: 1915 - DNA, 701 bp, Glycine max
  Predicted polypeptide sequence is orthologous to G2343
  misc_feature (82)..(83): n is a, c, g, or t
tacatggttggtggtgtctactgttggtgtccttgtatctaatgaactagtgtcaactataaatagggggcacgtcgaagannaataaggtttcttgcatcggtggctttgctgttaaattttcttggtggccatagtgatctagttgattggaattataattgatctgggcgggggggggatcacccacttggtgtagtggtcattgatgaagtcaccgaagaaggctttctaattttctttttgatccaagaattccagtagttctttatttcgttgtcagttctacctggtaagtggcttgcaatgtgagcccatctgttgccaacgaccccgtgaagacttataattaacttctcctcttcaggtgtaaacctgcctcttctaatatcaggcctcaaataattaatccatctcaggcgacaactcttaccacacctttgaagcccagctttctctggaacttcactccagcaaccatagccgtgagtggtaatgtatctgatgagcttctcatcttcctcgggggaccaaaggcctctcttaaccttctgttggttgcagcaagaatggtgacccatcttaattaatttctttgaagctatgtgcaagggtcttcttcctcgagccgaattccgagctttcgttccctcattggccttttattgcctggatcaaatgcggggatttcggacgcgtgg

SEQ ID NO: 1916 - DNA, 599 bp, Glycine max
  Predicted polypeptide sequence is orthologous to G2343
tagattgttatcatggttgggaaagtggtatagtattagattggaattgtaattgacctggtcagaagaattgtgatcgatactttgtgcaatggttgttgaagacaccgaagaagtctttcttattttcttttttatccatgagttccaatagttctttatttcattgtcagttcgacctggcaagtggcttgcaatgtgagcccatctgtttcctacgaccccgtgaaggcttataattaacttctcctcctcaggtgtaaacctccctcttctaatatcgggtcttaaataattaatccatctcaagcgacaactcttgccacacctttgaagcccagctttttctggaacttcactccaacagccatatccatgagtagtaatgtatctgatgagcttttcatcttcctcaggagaccaaagtcctcttttaaccttctgttggttgcagcaagaatggtgacccatgtttctaggctttgctatgtcgtcttcttctttttccttcttttatattcttgttccctaagtggccttgtattgccttgatcaaatgctgctcgagccgaattccgagcgtgcatacgacgtcatag

SEQ ID NO: 1917 - protein, 331 aa, Lycopersicon esculentum
  Orthologous to G2343
MGHHSCCNQQKVKRGLWSPEEDEKLIRYITSHGYGCWSEVPEKAGLQRCGKSCRLRWINYLRPDIRRGRFTPEEEKLIISLHGAVGNRWAHIASHLPGRTDNEIKNYWNSWIKKKLKKTSKSSTNTTSITDHHHHQHQNQRPQLTNYNTITSQQDIFFTQDIGTKSQVLLQDSTLFNSPNQLFFFDGGSLDSMTNVLINDATNRNATNNTSLFQETSILNSEFCWQVDQQQVQTSSYAIGMNSNYLPPLIESMVPPMEIPSSNNNNNIILEGQENNNELNEWNSQVDTQQCCPSYLFWDQENGSIGGDHEIIDPTTSNNMGQILSSFPSTL

SEQ ID NO: 1918 - protein, 664 aa, Oryza sativa
  Orthologous to G2379
MVSKKKKTVSRHTTESEEGRHSFEIVGYSLKKGIGVDEFVESATFAVGGYDWCIRFYPDGKGDGAKDYISVYLELLTKDCAVRAAYDLRLVNLATGLPKSVYSETTHRMFNSEDSSKFAPHYATFMHRSQLEMEASGYIKDDRLTIECFVTVVVQESMASNTVKAHELIKVPPSDILENFGELLEKGEGADVTFVVGGEKIAAHKIVLAARGLLHFIYTDSLPDMDDLSDDDYYEMIRLLLVAADRYAMDRMKLQCESILGEHLDVQTVATTLALADQHNCNGLKDVCIEFIATQNKMDDVVATEGYMLRTCPSVLVDVFEKASFQQQASWLQSAPISFQGFRPQESWMHSPNQVVGSASSHGSESASQCPARQEENNLVNIEESSDNSQETGRRGTRVNWTEEENLRLLSSWLNNSLDSINGNDKKGEYYWRDVAAEFNGNASSNNRKRTVVQCKTHWGGVKKDIAKFCGAYSRARRTWSSGFSDDMIMEKAHALYKSENNDKTFTLEYMWRELKDQPKWQRILEEDSKNKRTKISESGAYTSSSNQETEEETSRKEKRPEGQKKAKAKLKGKGKKPAPSPLGDQPSQDFVLFNEAVKLRAEAVLKSAEATTKSAEAKKEQTRMEKYQTYLKLLDKDTANFSDAKLKRHEAVLEKLATELAEE

SEQ ID NO: 1919 - protein, 290 aa, Oryza sativa
  Orthologous to G2379
MGRSHRLPALQDNKKRQLISSRQVKAAKTEVRRATRTNWTEEENLRLISAWLSNSVDPTDGNDKKGEYYWKDVADEFNNNRPTNGHKRTVKQLKTHWGNVKKDIGKFCGVYAQVRRTCTSGHSDDMIMEKAHLWYKNQSNQKKPFTLEYMWRELKDQPKWRSIIKKEENKNKRTKISESGAYTSSSNQETEEESSNKERHPEGQKKAKERLKGKGKGKAQSSPLGNQPSQNIVLYNEAMKIKAEALLKSAEATAKSAEAKREQIRMEKWQAYIKLEEKDTSNFSGEAEKA

SEQ ID NO: 1920 - protein, 399 aa, Oryza sativa
  Orthologous to G2379
MYYAIELIKLHVLAEEVDIGIVQALLMLSNLHINIVPSFGNMGALGIDLCRDLHPVVNGFLQQASWLQSAPISFQGFRPQESWMHSPNQVVGSASSHGSKSASQCPARQEENNLVNIEESSDNSQETGRRGTHVNWTEEENLRLLSSWLNNSLDSINGNDKKGEYYWRDVAAEFNGNASSNNRKRTVVQCKTHWGGVKKDIAKFCGAYSRARRTWSSGFSDDMIMEKAHALYKSENNDKTFTLEYMWRELKDQPKWRRILEEDSKNKRTKISESGAYTSSSNQETEEETSRKEKRPEGQKKAKAKLKGKGKKPAPSPLGDQPSQDFVLFNEAVKLRAEAVLKSAEATTKSAEAKKEQTRMEKYQTYLKLLDKDTANFSDAKLKRHEAVLEKLATELAEE

SEQ ID NO: 1921 - DNA, 1429 bp, Glycine max
  Predicted polypeptide sequence is orthologous to G2505
tgtttatcatacaatcaataattgcatttttttttcaattgacactatggtacttgacaaacaatggattgaaatattacaactaatgaagtcttctaatcaagtgaaaaacataacaaacaatcttaaatcgatcagtatcaaaatatatgtcctttttaaaatggttagagcctttgtaattatctccaaccttgaatgcacttaatttgtttataaatttcactataataaagggaaattaatcattgttttccataggcccagaagtccatctctcccctcaatgaaagttgattgatctggtggacagactgtggatttgcctcttcaaacctgacccctttggatgagtcctcatttccagcaagatgagaggtcactagcctatcaagaacaccccattcgtttattccttcacctcttccggttcccatttcttgatttggttcacacgacccaacttccatacctgactccgaaacttgatatcttaggccatcactgccgctctcacagtctctagggtttgtcatgagttgctttgccatgataggggtgtctgatgtatatgaataatcataaaccataggcttttgggtctgaagaagaggctcggattggaagagtgagtatggagggttttgcaagtgtggcggcgggtaatggagagccagctcaggcttatcaagctcaagccctgatgagttcctaggattttgctgttgatgtagtaagtagtgattttctctataggaccgtgcattagtgtttgaagaattgttgatttggtgatctggtttatgtgtagacccaccttcattttcaatcttgaataaattcttcttcttgaacactctgcacaccacccagccatcttcattggcacttccttgaggatcattgccatcttctaggcggtactcatgcatgatccaatcagtcttttgtccatgaggagctcttcctttgtaaaacacaagggtttttctcattccaatcttcttgaagctattcctaatgcacttgtctcttcctgttgctttccaaaaccctgcgttcgttgctctattagtccttgaacctgtagggtactttctatccttgtgactgaagaaataccactcgttttgtggagtagatccaattctacatctttcttgcaagtcccaaggctccatcttgttcaagtcgacctctctaatgacatccatgtcaaacttctgaaaggacaccttcttcttcaagtagtaatgaagcagctcttcatccgttggatgaaatctaaaccctggcggcacaccaccattagtcgacgaacccatcttattatctacaaattcaaactctcaatcacttaccaaatagatatttcaattcgctctatgaacttaatcgatttgaagctcgagccgattcggctcgagag

SEQ ID NO: 1922 - DNA, 802 bp, Zea mays
  Predicted polypeptide sequence is orthologous to G2505
  misc_feature (758)..(758): n is a, c, g, or t
aattgaagctctagctagctagctactttgcaaagtttgcgtgcttcgatcgtctcgatggctgacttctcgtccagcaacggcgtcccgccggggttccggttccaccctaccgacgaggagctgctgctctactacctcaagaagaagatcggcttcgagaagttcgacctcgaggtcatcagggaggtcgacctcaacaagatcgagccatgggacctccaagagagatgccggatcgggtctgcgccgcagaacgaatggtacttcttcagccacaaggaccgcaagtacccgacggggtcgcggacgaaccgcgcgacgacggccgggttctggaaggcgacggggagggacaagtgcatccgcaccagctaccgcaagatcgggatgcgcaagacgctcgtcttctaccgcggtcgcgccccccacggccagaagtccgactggatcatgcacgagtaccgcctcgaggaaatcgacgaagcccagggcggcaccagcgaggatggatgggtggtgtgccgcgtgttcaagaagaagtgtttcttcaagatcgccggaggcggcgaagggagctcaagccagagcgcggacgccggcgccggccacatggccgtgtcgtcaccactgggtggccacgaccacgctgacagggccgccatggcatctcactacatgcacgggatgcacccgcagtaccacccccagcacgcctcttccttctactactcccagatgcaaccaccggaggcggnctactcgcaccacgtgcaggtccaggacctcctcacaaccaccg

SEQ ID NO: 1923 - DNA, 1262 bp, Glycine max
  Predicted polypeptide sequence is orthologous to G2520
cggattcggctcgggtaggccacagtcacacacagcctttgcctttgcctttgctgttcagtgctcccactcccagtccgggccgaggcagaaaatatcggaaactaacctttcacactcacacatccatcgtcatatctgaattggcaactcattattaaatcaattacgaaaacgaagaaacccaacaaaacaatggtagtagcttagctaattgcctaattgaatgaatctcaatggaacctcctctcatcaacgactccacattctcttccgctaacccttccttgtccgagatttggccctctcattttcccacagaccacactcccagtaacaagagacacctctccccctcgactgattgtggcagcaataaacatatcaaatcatcaggatcaggatcccaggatcaaaacggtgccttgaaggcgggtgaagtggacgcgacttcagtagccggtaacaagttacctgaacaaacggcgaaacctagttcttccgagcagccacctaagcaagactatatacacgtgcgagctagaagaggccaagccaccgatagccacagtctggctgagagagctaggagagaaaagatcagtgagaggatgaaaattcttcaagatatagttcccggctgcaacaaggtaattggtaaagcacttgtgctggatgagataattaattatatccagtcactgcagcatcaggttgagttcctttctatgaagcttgaggcagttaattcgagattgagcatgagccctactattgaatgttttccttcaaaagaagttggcactcagccatttgaccttgccggaataatatttggatcacaaccggccaggggatatgctcaaggatcacagccgggatggctgcatatgcagatagctggtggttttgagaaagcaacataatttgagggaggttcattgggaatgacagatcaatcagtgtggttggttttccattgaaaaggaaaaaagtcacttggctggttggttagcatgcgctgctctattaacaacctagtcaattgatgcaaaatgttgtaaggtctgtatgttctttgtcatagtatgatatcgattgtaagaaatgcatctaatttcctcgcgcatcatctgactgggaacgtagtgctgcaccatgttagcaattgaaataatcttattgtggtttagttttcgtttcaaaaaaaaacaaaccaaaaaaaaaaaaaaaaaaaaaaaaaaaaaaaaaaaaaaaaaaag

SEQ ID NO: 1924 - DNA, 1312 bp, Glycine max
  Predicted polypeptide sequence is orthologous to G2520
caatgccactcttcttcctttctctttcccactgagagagactgcaaactaatttctagtattccgacacagataatggatccggcggcgatgatgaacggcggcgccaacccgacgtcgtatcacctgtcagagatctggcagttcccgcctcccaacgcgccagacgagctgggactcagaaggccccacttcacccacggcttcgcggacttcgccccggatccgacccgagacgccgtcccgggtcgcgacccggccagcattgcccagaagaagcgccgcgacgcctcggccgaggaggaggaatccgctaagggcgcctccaccaccaatgccgtgaatgaggggggtggtgttggtgatgggaaacgggtcaagacgagtgagagtgggaaaggtgaaggagaaaccagttcaggaaagcttgcggagcaaagtggtaagccaccttcggagcctccaaagcaagactacattcatgtccgagccagaaggggtcaagctactgatagccacagtcttgcagaaagagctagacgcgaaaagatcagtgagaggatgaaaattcttcaggatatagtcccgggttgtaataaggttattgggaaagcattggtccttgatgagataattaattatatccaatcgcttcagcggcaagtagagtttttgtcaatgaagcttgaagcagtaaattcaagactggcccccagaattgaagtgtttcctcctaaagattttgatcagcaaacatttgatacaactggcatgccgtttgcttcccaagctacaagagagtatagccgaggttcatcaccagaatggttacatatgcaggttggaggtggttttgaaagagcaacgtagtctttgaaatcccatcacctgataataaatgcatataggatcattaatctctccatcagagctcccataaatcatatactcaaggtgttgttgcttagtcctatagacacctcattccctgttttctacaagagaggcatggagctgtggtttgtttccacaggatcacttcagttagtactcaagcaactccatttgttagtgtgttggaaaatgaattcatttacccaatatgtagtttagtatgctgatactcttcatataacctttaaaatgattgttattattcttgtaaaagaatgctgcttgtcctgaatacataaaggcttacatattgtgtaatagtatcaacattgttgtttgtctgtgaagctgtgttgaataaattaagcccatgtgattttgttaaaaaaaaaaaaaaaaaggagacagaaaaaaaaaa

SEQ ID NO: 1925 - DNA, 581 bp, Oryza sativa
  Predicted polypeptide sequence is orthologous to G2520
cgggctgcaggaatcggcacgaggtttttttttttttttttttttttttttttatagcaagagaattattgatggttattacttttctttcatgctacgaatgagcgtgacctgccgaaattccgtggaatacatgaatctgatgagaattgtatcccggtacagatgtaaaaatactgtgctcgcagtctctaaatacatgagctccatgctatgaatgaaatcgaatttggagcacgagagtttcgaaaaataatctaaagccgtggtttctgactgaactcatggtatgctttattttgggccaccatcctgactttgttctgttcatgtcactctttcataggtgccaccaatctgcatgtggagccattccgatggtgttgatccctgggcgtattctcttggtgtttgtggatcaaacgtcaatccaggagccgtgttgtatacctgagcaccaaaatcttagggtggaaatgcttcgattccattattcacatgagcattaacagcctcaagcttcatggacaaaaactcaacttgccgttgcaaagcctggatataattaattatctcatcaa

SEQ ID NO: 1926 - DNA, 811 bp, Zea mays
  Predicted polypeptide sequence is orthologous to G2520
ctcgaggccggccgggatataaaggcagtctaagaacagaggttgaaactgactcaagaagtgctggcaaggctgttagtagaaacattccagcagcagagccaccaaaacaagattatatccatgtcagggcaaggaggggtcaagcaactgatagtcatagtcttgcagagagggcacgtcgtgagaaaataagtgaacgaatgaaagttctccaagatcttgtgcctggatgcaacaaggttattggcaaagcatcagtacttgatgagataattaattacatccagtcgttgcaatgtcaagttgagttcctgtccatgaaactagaggcagtgaatgcccaggcaaaccagggagttgaagtatttccagccaaagattacggttctcagacatacaacacagctcctgggctgacatttgatacgcaaaccagtagagaatacgcccagggcacgtcgacctcggaatggcttcacatgcagattggcagtggctatgaaagggtttcatgaacgagatgaatccaggcagccgctaaataaagtgaaccatgatcaatcatggccgtgcttgtagatcattctttttcattttttttgaaaccatcatgttccagacgcattttttattcatgcttggagctgtaattccagccggaacatgtatttttgatgaggcgctcatttgtttccccatctgaatctcaagactgtttctgctgttcatgtattccatggaatttctgtagatcgcgttcgtctgtcagaaggatgaataaatcagttgatgctttgattttgaatcc

SEQ ID NO: 1927 - DNA, 407 bp, Zea mays
  Predicted polypeptide sequence is orthologous to G2520
gggcaaggaggggtcaagcaactgatagtcatagtcttgcagagagggtaagtggaatgtaacattttctgttgtaaaaatgctattgtatgaatttcaagtggtctaaaacggtaggagcatcacttctgtaagttacatacaacatgaacttgaccacttaaagatcttgttgttttaacaggcacgtcgtgagaaaataagtgaacgaatgaaagttctccaagatcttgtgcctggatgcaacaaggttatgtggcaaagcatcagtacttgatgagataattaattacatccagtcgttgcaatgtcaagttgagttcctgtccatgaaactagaggcagtgaatgcccaggcaaaccagggagttgaagtatttccagccaaagattacggttctcagaca

SEQ ID NO: 1928 - DNA, 1716 bp, Zea mays
  Predicted polypeptide sequence is orthologous to G2520
cacctagtgaaaaaaatgacagaaggacagaagctgaaacaaattcagggaacgctagcaagtctgctgataaaaagcctgcacctaaagagccaccaaaagactacatccatgtgagggctagaagaggtcaagcaacggacagccatagcctcgcagaaagagcacgacgagagaagataagtgaacggatgaaagttcttcaagatattgtccctggatgcaacaaggttatcgggaaagcatcagtccttgatgagataataaattacatccagtctttacagcgtcaagtagagtttttgtccatgaaacttgaagcgattaatgctcatgtgagcaatgcaactgtagcttttccaaccaaagattttggtgttgcgccatataatactgctcctagcctgacgttggacccacaaacgccaagggaatacgcccagggctcgatgtcagattggcttctgtcatgggcatcatagggagcgagaggcaacagccaagctgggataaggctagagaataagattaagattagctgggataaggctagagaataagattgagatgagagaattgtggagagttagcagcagataagtccaagaaagtaggagttagttgagagtttgtagaagttggttagctatagggctatttataagccgcatggcagcagagaataaatcaagcaagatcattatcaaaccaatctctctctcttgcaatgaccctctcaagcgcctagggctgctaccctagaaccaagcctgcggcagaggggtataacctcgccggagaagacagctatccccatggaccgaaggtcgacagaaagactacacatatttacaatgggcaaaacaagccaagtacatattgtgtgtgtactttttttgtactccagatcacttatctacgttcaccaaactgatgcggagacgaaacacctcgtggacagctccacggttaagaatggcaagaatctctgctccctcagccgtggtgagctcacctagcgagattttgcgggactcgtactcatcaggcaaccggaaaccatagaaccacctaccaagcttgagcaagttcacacaaaccatcctttctgatacactgtgagcttggagtgctttactgacttcagctggcagcacatgcaaagatgcgatcgagtagtgcagtccaattaggtttattatcgcactatggttccttgaaaacaagaaaaactggacatcgagaaatcctatatcaagtatcatggccaaatcagcaatagctttcagatagtattcggattcaagtgacgcattctctcagctagggtcctccacgttgtcccccatcagatcttgcaccagccattcttcgttgtcggctgatgtagagagctttccagccctgcatacgggacgacgacgccgacgcctccgccacggcagctggccaccggcagcgaaagaggcgctcccagatgcagtcggcgtcgcaggctctgcgccaggtgcgcgagcagccgccgagcgcgcacacatcagcctcctggaggcgggaggcgacgtctagggcgatgtcctcggggaggtcagtccacctccccgccgatgagagctccatttcgcgcgattcccctttcgccgctgcgactgtacagtaccagactaccagagcatcttcaaggtgtgagaaatttcactattgtgtcccggccgg

SEQ ID NO: 1929 - protein, 265 aa, Oryza sativa
  Orthologous to G2520
MDPAPTLAAELWRTPYLGGGGGGGGGGRGLEAAASGVTEQSNGSRGGGGGGGAGRRRQREAPALEDDSSRIVSTSGGGGGGQDLTDSEAKRFKASKSSGDNSSLRTEAETDSRNASKSGDQNPPPPEPPKQDYIHVRARRGQATDSHSLAERARREKISERMKILQDLVPGCNKVIGKASVLDEIINYIQALQRQVEFLSMKLEAVNAHVNNGIEAFPPKDFGAQVYNTAPGLTFDPQTPREYAQGSTPSEWLHMQIGGTYERVT

SEQ ID NO: 1930 - protein, 256 aa, Oryza sativa
  Orthologous to G2520
MDPAPSLAAELWRPHHHRHHFEASSVVTDQGSGSRGGGGSGRRRPRSDAGPEDDDLSKVVSTSAASGGGGGGGQDSDAPEAKRLKPMKSSDKNDSLRTEAGTDSGNSSKAADKNATPPEPPKQDYIHVRARRGQATDSHSLAERARREKISERMKILQDLVPGCNKVIGKASVLDEIINYIQSLQHQVEFLSMKLEAVNSHMINGIVAFPSKDFGAQPYNTAAGLTFDPQTTREFAQGSTSEWLHMQIGNAYERVT

SEQ ID NO: 1931 - DNA, 423 bp, Glycine max
  Predicted polypeptide sequence is orthologous to G2557
aggtggtttcaggcttatctcagagacttcaccaaagtccaagagacccagatggattcataagcatcctggttcatcaaatatcaacttccagcagccaaattcatctgtgacaccttcctttgaagaacctgatcctgaggtcatagcacaaatgaaggaaatgatatatagggctgcagcttttaggccagtgaacttgggccttgaagcggtggaaaagccaaaaaggaagaatgttaggatatcaactgatccacagacagtggctgccaggcaaagaagggagagaataagtgagaggattagggttttgcagaagattgtgcctggtggaagcaagatggacactgcatcaatgcttgatgaagcagcaaactacctcaagtttctcagatcacaagtcaaagcactggaaaatct

SEQ ID NO: 1932 - DNA, 417 bp, Glycine max
  Predicted polypeptide sequence is orthologous to G2557
ggttaggatatcttctgatccacagactgtggctgccaggcaaagaagggagagaataagtgagaggattagggttttgcagaagattgtgcctggaggaagcaagatggacactgcatcaatgcttgatgaagctgcaaactacctcaagtttctcagatcacaagtcaaagcactagaaaatcttggtaacaagcttgacacaatgaattgtcctcctactaacatagccttctctttcaacccttcttttcccatacaaacacatttccccatgcaaaaccctagcagccacatccaatactccaagggttgaaaacttgacatgaatattatcatggaagataagatgtaaaaaggggtctgagaacccataacctctaattttattccatccagtgagtatgattaacgtat

SEQ ID NO: 1933 - DNA, 701 bp, Glycine max
  Predicted polypeptide sequence is orthologous to G2557
ggctagaaaatgaagatcagatatgttaatcgttgagattggtaatgaaatgataggggtcatggggggttgttttgtttgaccccatgggaatgatggatgtgacagaggggtggtgtttgcatgggaaaagaagggttgaaagagaaggcaatgctagtaggaggacaattcattgcatcaactttgtttcctagactttccagtgccttcacctgtgacctgagaaacttgaggtagtttgcagcctcatcaagcattgatgctgtgtccatcttgcttcccccaggcacaagcttctgcaaaaccctaatcttctcatttattctctcccttctgtgccttgcagccacagtttgtggatcagttgatatcttcacattcttcctcttcggcttttcagccacctccaacccaaagttcactggcctaaaagctgcagccctatatatcatttccttcatttgtgcaattgcctctggatcaggctcttcaatggaagaagaaatggatgaatttggttgctggaaattgatattatttgaggaggaactcatatcccatcttgatttcttgcattctggttgattaatatctgagacaagtctgaaaccaccttcttcaataggagaagaattctgaacaatactgaagcaggaatcaccaactttgatcattttagattgatcatgggcatgact

SEQ ID NO: 1934 - DNA, 545 bp, Zea mays
  Predicted polypeptide sequence is orthologous to G2557
cgggccctaggccgtcggcgcggcgggggcgggcgcggagaggccccggcggaagaacgtgcgcatctcgagcgacccgcagacggtggcggcgcggctgcggcgcgagcgcgtgagcgagcgcctgcgcgtgctgcagaagctggtcccggggggcagcaagatggacacggcgtccatgctcgacgaggcggccagctacctcaagttcctcaagtcccaggtccaggcgctggaaaccctaggcacgacgacggcgaccaacgccaacagcagcgcgagcgccaccaccagcaggagcagcgcggcgagcaggtcgccgcagtacaactattacggcggcggcggcaataataataatcctgccggctttcttggattcagtaacgttatttctccggctgggtatgtaaatccgggtgcatcgtcgtcgaatactggcagcaacaaactgctgttttagtgactgttcttgtgtgattgttgtttgtcgtccggagcggacgatgcacatacacatgcatgcatgcatgttgctgtttccc

SEQ ID NO: 1935 - DNA, 1614 bp, Zea mays
  Predicted polypeptide sequence is orthologous to G2557
cgaggaccatcctcgctaccctgcaggccggcactgcactgcactgcagtctacagaactcgtcagtcacagatcggtgcaggcggtctgcacctgcatcacctaaccaattcctcgattagtctgctgttgcgatttgcgaggcaggtcagcttgtgtttcttcattctgtttgcacgatgctgcaatctttttgcagcagccactaaacctgtaccaagtcttcttgcctgagggcagaggcaggctccgtcagtcacgccggcggcgtacagatcatggaggactttggcggctggaatatgcagtatgcagcagagctatgcctgccaagccgccgggacgacgacgacgacggcctcctcggtgacttcctaggcggcggcggtttggacatccgttctgaccatggcggcctcaacctgccctcgtcgcaccctgctgtccagaaccttgtgccctgccacggcggcgtgagtctttccgtttccgacgccttcatgggcctggacacggcggatatgctcgctagcgtcaccggcgcactggactgcagcctcctcgacacgtttgcttgcggttcggacgccgtcgtcgtcgccgaggagcccgccgcgcagcccaccgcgtcgagcaacgccttctccggatacagcagcaccacgggcggcaattacggcaacatctcctccggcgagtccaacacgtacggcggcagcggcggaggccatgacacggaggttgcgtcgccgacctgcgcctcgaagcggaagctggccggcaagtaccctgcaatagccgcgtcggcctcggccacagccacgacgacaacggcggaggggcaggttgcagccccgcggcgtggcacgaagcgcgactccgcgacgtcgtcttcgtcgaccagcgccacggtcgccgggcatggcggcggcaaccatgcggccggaggaggcgggtcgtcgtcggtcggcgacgggaacgggtacgagccggactcggaggcaatagcgcaggtgaaggagatgatctaccgcgcggcggcgatgcggccggtgcaccagctcgtgtgcggggccgccggcggcgagccgccgtcttcgtcccagaacaagccgcggcgcaggaacgtgcggatctcgagcgacccgcagacggtggcggcgcggctgcggcgggagagggtgagcgagcgcctgcgcgtgctgcagcggctcgtgccgggcggtagccggatggacactgcgtccatgctcgacgaggcggccggctatctcaagttcctcaagtcgcaggtcaaggcactggagagggcaaaccctagtagtaatggtggctacaacgacagcagcttcctgccgcagaattacacggggtgcctctgtgtcgacggtggcaccagtgttgcctttggaagcgatggcgccattgggggctacgtaaaaccaggtaggaacatgcaccggtagcgatgcaataatgtaaccattgatgcgagtgagcgatatatgagagaagtactgcagtactgctactggattttgagtttaataaggctttactgtatttctgagtaataataatcaaaacgatttgatttaaaaaaaaaaaaaaaaa

SEQ ID NO: 1936 - DNA, 423 bp, Glycine max; identical to SEQ ID NO: 1931
  Orthologous to G2557

SEQ ID NO: 1937 - protein, 393 aa, Oryza sativa
  Orthologous to G2557
METFGWAGGGQLMHHDDIYLPRSVGCGRPFELDDAFLGACFGAQLQCDGGVGGGDGGGCLQGTSGFGAVAGDPLGLLCSGDVFASVAEGAGGAHDDGLLDAALAFSRNQLGGAACDGSDGGAVSNGAMLSSYSGTTGGNISSGESNNYSGGGGGYDAEVVSPTSTMSAATQSLHPKRKLYDDHHHPAGIAAAAAAPPLAPCPRPTTGAVAAKRRASTSATSITFGHQPHHHHAGATTAGYEPDMEAMAQVKEMIYRAAAMRPVHLGTEAAADKPRRKNVRISSDPQTVAARLRRERVSDRLRVLQKLVPGGNKMDTASMLDEAASYLKFLKSQVQKLETLGTTTTTSKLPQQYYSGNINSSNNHHGFLGFAANNNTISAGYANSNAGNATKLL

SEQ ID NO: 1938 - protein, 146 aa, Oryza sativa
  Orthologous to G2557
MRPVTLGGAASASDPSSAAPPPPQRPRRKNVRISSDPQTVAARLRRERVSERLRVLQRLVPGGSKMDTATMLDEAASYLKFLKSQLEALETLGNGNGNGNLLHHGYYTGSRNATATAATGSSNSTVLAFGRDGLAGFVKSNRNLQL

SEQ ID NO: 1939 - protein, 484 aa, Oryza sativa
  Orthologous to G2557
MFRSAVAVSQLATTTTVWMDRGFNEMILSESVWNGGGGGGDGDGGAVVLPPEVGGVNAVDGSGMTMLERLVLDEALAAAILELQGIQAPGCGGGGGKVAVVPPPTAGDGGVEAAVAFAAMATGTPAYADVDADVLQRQRQHHHRHQGAMGMAAEYDVAPATPAVTLSAVPPPPPPPAFATAAASVDGGGAMDATVFSGIGNDDVVDAVSATVAMTTATATTSQCERVRGGGGGGGCGRKQRRPGRKRKAAEPTAAAAAADMSSQDNPLCSLLASNTAGADGGIQIAFSTSAPASKRAKPSLSSSSSSISFDGRGPGGNCGGGGGDDPLYEPDTEALAQVKEMIYRAAAMRPVTLGAEDAGERPRRRNVRISSDPQTVAARQRRERISERLRVLQKLVPGGAKMDTASMLDEAANYLRFLKSQIRELQTLDRRNYPNAAMSINTAAATTMATSSSPTYNNSNAAMPAFAFPETLGCGGGGVEQLI

SEQ ID NO: 1940 - DNA, 925 bp, Glycine max
  Predicted polypeptide sequence is orthologous to G2719
  misc_feature (896)..(896): n is a, c, g, or t
  misc_feature (911)..(911): n is a, c, g, or t
gagttaatcaacgttaatcaacttgttctcgttaattagtactgaaaaatgacttccaagatacaaatattatcaatcctaggcatgttggccatgttctttcttatctccacggaggtgttagccactggattacatggtgttggtgttggtggtggattacctggtgttggtgttagcgctggattacctggtgttggcactggattacatggtgttggcggcgctggattatctggtgctggtggcgttggattatctgccgacgcgggattatctcgtgctggtgacgctggattatctggtgctggtggcggccgtcgtggtcgtgctggctccccttctttgtgttttttctctgtcattttctcgaacaggtgaaaggcgacgacaacgatgaccggtggccacgatcgcgtgaagggttcatggagtcctcaggaggatgcgacgttgctgaaactcgtgaacgagcacggggcacgcaactggtccgtcataagcgccggaatttccgggcgttccggcaagtcgtgccgtctgcggtggtgcaaccagctgagtccggaggtgcagcaccgtccgttcactccggcggaggacaagatgatcataaaggcgcacgccattcacggaaacaaatgggccaccatctcgcgcctcctccccggccgcaccgacaacgccatcaagaaccactggaactccactctccgccgccgtcgcgcggtggagtcatcctcctcctcatcggcgtctccgccggcgaaacgtcactcttccttgtttgacacgcttcaccctttcaagaaacagtgcatcgagaaggaaaacgaagaagagcgagtgctgagtcccgttacgacgtcgttgagtcttttctcgagcgcgaattnccgaggcttagcgtnacggcgtgccatgc

SEQ ID NO: 1941 - DNA, 1875 bp, Zea mays
  Predicted polypeptide sequence is orthologous to G2719
cattgggtacctcgaggccggccgggatctagcggcagagaccaaagtgcccatcgcaccatgtcggccgccgaaaccgctgtttctccgacgacgccgccgcagccgcagctgcaatcggatccgaacgccgccgccgacgcggccagttccaattctctctgggtggccgacgagacgcaaaccctaaccgaggtcctgctccaaccccaaccaaaccacctgtcgcctcctccttctggtgaaggggacgacgggatcactgcctccggtgctcctgttggtggggacgccgcggcatccgcttctgctgctgcggcggctaacgcgacgatagaagagcgggtgagggggccgtggtccccagaggaggacgcggtgctgagcaacctcgtggagaagttcggggcgcggaactggacgctgatcgcgcgtggcatcccggggtcgctccggcaagtcctgccgcctgcgcgtggtgcgaatcagctcgacccccaagtcaagcgcaagcctttcactgaagaggaggaccgcattataatggcagctcatgctgtccatgggaacaagtgggcatctatcgcaaagcttttggatgggagaaccgacaatgccatcaagaatcactggaattccaccctgaggcgtcgctactgcaatgatggccaatgcaagcatggtggttctgtggagcgaagtatctcaaaggtgtccagggaagtttcagaagaaccttggcctttaaacgatcttaattccttcaccgctatggatgtaaaggatgatcctgtgcaaacggctccagatacttctcctcgggcaaggcacatcacagatcattgttctattactcaagtagttgatccaccatacctgtcccgaccagcggcaaagattggtgctttcagaccatattatctaggacacacggaacctacccaacaagaaatgccaggtggctgtcgtcaagtttgactcaactcataaagtctcgactcctgaaagcgaggtattcaagtttgttgatcctatatgctttgctgctgaggtgccagacaaatgtgggtatggttgctgcggtgctcatgagcagcatcgtaagaactcattgctgggtcctgagttcagtgagtttgaaggtcatccacctgttttaaatattagctttgcttcattggtatcagaaattagcagcattgcctggatgagaagtggtatgcaaagcagtgattccagcaacttgatgcaatcaattccaccaacctgacaaagtaggaatcttatgtcagtggcggatccagaaacagatcaaatgaggggctaagttatggattggggaggctggagatggctgcaatgcgaatgaatggaaccaccatgtaaataatgtgcgaattacaaacgcgtgtgggttgctgtgtgccgtgcgcatgggtgatgaactgatggacctgcattgtgctgttatgcgcctgcatcttgtaatcgtgggccttcttcgtattactatgctgaaatcactaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcccttttaaagaaacaaagttaacgaccccggcaatgcggaggaaaagtttttttttggggcacccaaaataaaatccatggcccgtggtttaaaaacgcggggatgggaaaaaccttgggttacccaaattaatagcctttgagaaaaatccccttttcgccggttggggaaaacaaaaaaagcccccacacctatcccctttc

SEQ ID NO: 1942 - protein, 413 aa, Oryza sativa
  Orthologous to G2719
MSSETAASPPPPPPNPPAADSTHSSPASMTDETHGAGAHPDESQPHRSSSSSSSPPVAVDGETRVPLPVRSLPQPSHPSPPPSGEDEDDVVITGQIAVGDAAGAAMEERVKGPWSSDEDTLLSNLVEKLGPRNWTLIARGIPGRSGKSCRLRWCNQLDPQVKRKPFTEEEDRIIMAAHAIHGNKWAAIAKLLVGRTDNAIKNHWNSTLRRRHCTGGRCTQGGVMKRAIPERPRSVSEEPWPLGNLSSLNVREAMEAPAQTVSESYVGAWQIGDQSCKTEVVDPPYLARPVAKVGAFKPYNVGPAQSSQKEMLSFATKFDSNLHPFKPENGVCKFVDPTSFAAEVPNKCGHGCCSSHGQLRKNSLLGPEFNEFEDHPPISDSSFASLVSEISSIAWMKSGLQSSDTLARSVPPA

SEQ ID NO: 1943 - protein, 242 aa, Oryza sativa
  Orthologous to G2719
MALEGAAGGGGVGGGGGPPGQEAGKKVGWSKEEDKLLRELVRKQGGKDWGVIATAFPGRTDKSCRLRWRQHLDPSVDVALPFSAGEDRKIVELHRVHGNRWATIAAFLPGRSDNAIKNRWNTHLRKRHAQDVQQRPSGGLALGLGGGGGAGQAAGGKLTPVCLQLFPPTQAPPIGENLPGPARSAVPELLKLFPLAPGDLKDNASAAAAMDVGNEAVRALPELRLSPAAVVFDAMPLQAIRM

SEQ ID NO: 1944 - DNA, 1059 bp, Glycine max
  Predicted polypeptide sequence is orthologous to G2789
ttagagtaaacgaagttataattaagcaagaaggagaatgaacagtgatgataataagagaaagtcgaaattaaaaataaaaaaagacaaacaaaaataaaataagaaaaagaagaaaacaaagataaccgagaaaaaaaccatgaaagtaaaacactttgttaaaagggagggcgagcactgccaccccaataaccctcagccggtaattgaattgaattgagaagattctgaggcactccatggaaaagagaagaactatttggatctcccacaagctgttgttgttgctgttgcggctgcgattgtgattgttgctgagtccccgggattcctggggaccctaatccttcggtgccatgatatggcaccggagtttcctcttcctctaagggtagtctctcataagcagcattaccaaatgaagcagccatgatgaccacagggcctgaagccacaaggggtcccaccacacttccacctactacctgtccctgtccgccagccagatatatggctagtcctgacgccgctggcggagccggcggcggcaggaatgaaccggacagggacagaatctcgaaccttccgtgaagggtcacgacggcacttggcgaggccggctgtcggagtgtgacgttggtgacggtgccacttccgctgagcacgcagatgccacgctgccgccgcctcgcgaaggcggtgacgctctccatgatgtcacagccgttggtgatttccatgacatgggatcggagggcgttggcactgtctcttgtgatgataatgggtggtttgggcttgtttttggaccctgcgggtcttcctcttggtcttctccccatgtcactccctcctccctcttctgacccgggttccttgccctccccgccgccgtgggggggcgtggtggccccgcctccgccaccgacgttctcatcgcgatctcgcttctggccgcggccattgccggcttcgtcctcggtgttttggttgttgtggtggggctggaattgatggtgagggtgtaagtgaagatctctagttagaaaaggtgga

SEQ ID NO: 1945 - DNA, 488 bp, Medicago truncatula
  Predicted polypeptide sequence is orthologous to G2789
tggcaatgggagcttaagccgaggccaaaaaagagaacgaaaaacaaaccaaaaccacctatcatcatcacgagggacagcgcgaacgcactccgatcccacgtgatggaagttgcaaatggatgtgacatcatggaaagtgtgacggtctttgcgcgaaggaggcagcgtggtgtctgcatccttagcggaagtgggaccgtcacaaacgtgactctccgtcaaccagcatcgcctggtgcggtagtcacacttcatggaagatttgagatattatcattatctggctctttcctgccgccgcctgctccaccagcggcgtcaggattagccatatatctagctggtggacaaggacaggtcgtcggtggtagcgtggtgggaccgttgttagcttccggtccggttgttatcatggcagcttcctttggaaatgctgcttatgaaaggctacctttagaagatgaagaaacaccagtgaatgtgcc

SEQ ID NO: 1946 - DNA, 2169 bp, Glycine max
  Predicted polypeptide sequence is orthologous to G2830
ggctcgagaaaagatagagcaaggaactcataaaagtgggaggaatgtggggttgaaagcttatgttgtgtgccaagtgcttgagattgttgtcaaaaaggaaataaaacaagctgaaataaaatctacacaagtcaaaatcaggaggttcttccgaccagaagatttatcaaatgagaaggcatattgctctgatatacgagaggtgtattacagtgatgaaacatatataatctctgtagaatccatagaagggaaatgtcaagtcagaaaaaagaatgatattcccgaatgcagtgctcttggtggaatcttccaaaatgtttttttctgcgagctcttgtatgatcctgccactgggtcactgaagaagttgccggctaatataaaagtaaaatattcaagtggacaaacatctgatgctgcagctagaaagaggaaaggaaaatgtatagagggagatggtgtttcagagtccacaaaggaaggaaaaacattaaatgataaacgtttagcaaccttggacatttttgcaggctgtggtggcttatcagaggggttgcagcagtcaggagtttcatcaactaaatgggctattgagtatgaagaaccagccggggatgcatttaaagctaatcatcctgaggcattggtgttcattaacaattgcaatgttattcttagggctgtaatggagaagtgtggggacacagatgattgtatctcaacatctgaggctgcagaattggctgcaaagcttgatgagaaggaaataagtagtttaccaatgcctggacaagttgatttcattaatggtggtcctccatgccagggtttctctgggatgaataggtttaaccagagcagttggagtaaagtccagtgtgagatgatattggcattcttatcctttgctgattatttccggccaaggtatttcttgttggagaatgtgaggaactttgtgtctttcaataaaggacagacattccgtttaactttggcttcacttcttgagatgggctatcaggtgaggtttggtatccttgaggctggagcatttggggtttctcagtcaagaaaaagggcattcatatgggctgcttctcctgaggatgtgcttcctgaatggccagaaccagtgcacgtcttttcggcccctgagttgaagatcacattatcagaaaatgtccagtatgctgctgtccgcagtactgcaaatggtgctcctttacgtgcaataactgttcaagatactattggtgatctcccagctgttggcaatggagcctcaaaaggaaacatggagtatcaaaatgatccagtctcatggtttcaaaagaagattcgaggtgatatggttgtcttgactgatcatatatcaaaggagatgaatgaattgaacttgattcgatgccagaaaattcccaagagaccagcacctggtctcttggcgtgaccttccagaagaaaagataaaactgtctagtggacaagttgttgatttgataccatggtgcttgccaaacacggctaagcggcacaatcaatggaagggactgtttggcaggttggattggcaaggaaatttcccaacttccgttacagaccctcagccaatggggaaggttggaatgtgcttccaccctgaccaagataggattcttactgttcgtgaatgtgctcggtctcaaggcttcccagatagctatgaatttgctggcaatatcatacacaagcaccggcagattggtaatgctgtgcctcctcctctagcatcagcattggggagaaagctcaaggaagcagtggacagtaagagctccacttagaagatgggccttctacattaggtcatgcttattgtattcataacagtcaccaagatattgcaaatcatcattccgggttccaaaaactagaaacccttgtatatagtgatatccattggtcatttgttgaggctaattccttgtttaactttcctcaaccaaggaattgaatggatgatgctcattttctatcaactaggattttcttgattagatggtattttggctgtttatgaaagaaatggttgggaattgattacctcccaatgtgtagttgaaaattgagaccaattttttttaacctgttatgaatatttgttgttgccactatttggct

SEQ ID NO: 1947 - DNA, 1699 bp, Arabidopsis thaliana
  G5  Predicted polypeptide sequence is paralogous to G974
ttttttttttgcaatctccccctaatctgttgtttctcgcttcttcttctgttaatcatctgtctttcaaaaagaaagaaaaaagaaaaattcgatttctgggtttgtttttgtcatacagaaaaaaatcaagcttatgaatttgtgtttaattttttgttttaatttgaaaggcaggttttttcagaacgagatcgttttttcaaatttcttctgattttacctctttttttcttcttagattttagtgaatcgagggtgaaatttttgattccctcttttcggatctacacagaggttgcttatttcaaaccttttagatccatttttttttaattttctcggaaaaatccctgtttctttacttttttataagtctcaggttcaattttttcggattcaaatttttattttaaatggcagctgctatgaatttgtacacttgtagcagatcgtttcaagactctggtggtgaactcatggacgcgcttgtaccttttatcaaaagcgtttccgattctccttcttcttcttctgcagcgtctgcgtctgcgtttcttcacccctctgcgttttctctccctcctctccccggttattacccggattcaacgttcttgacccaaccgttttcatacgggtcggatcttcaacaaaccgggtcattaatcggactcaacaacctctcttcttctcagatccaccagatccagtctcagatccatcatcctcttcctccgacgcatcacaacaacaacaactctttctcgaatcttctcagcccaaagccgttactgatgaagcaatctggagtcgctggatcttgtttcgcttacggttcaggtgttccttcgaagccgacgaagctttacagaggtgtgaggcaacgtcactggggaaaatgggtggctgagatccgtttgccgagaaatcggactcgtctctggcttgggacttttgacacggcggaggaagctgcgttggcctatgataaggcggcgtacaagctgcgcggcgatttcgcccggcttaacttccctaacctacgtcataacggatttcacatcggaggcgatttcggtgaatataaacctcttcactcctcagtcgacgctaagcttgaagctatttgtaaaagcatggcggagactcagaaacaggacaaatcgacgaaatcatcgaagaaacgtgagaagaaggtttcgtcgccagatctatcggagaaagtgaaggcggaggagaattcggtttcgatcggtggatctccaccggtgacggagtttgaagagtccaccgctggatcttcgccgttgtcggacttgacgttcgctgacccggaggagccgccgcagtggaacgagacgttctcgttggagaagtatccgtcgtacgagatcgattgggattcgattctagcttaggggcaaaataggaaattcagccgcttgcaatggagtttttgtgaaattgcatgactggcccaagagtaattaattaaatatggattagtgttaaatttcgtatgttaatatttgtattatggtttgtattagtctctctgtgtcggtccagcttgcggttttttgtcaggctcgaccatgccacagttttcattttatgtaatctttttttcttttgtcttatgtaatttgtagcttcagtttcttcatctataatgcaattttattatgattatgtg

SEQ ID NO: 1948 - protein, 334 aa, Arabidopsis thaliana
  G5  Paralogous to G974
MAAAMNLYTCSRSFQDSGGELMDALVPFIKSVSDSPSSSSAASASAFLHPSAFSLPPLPGYYPDSTFLTQPFSYGSDLQQTGSLIGLNNLSSSQIHQIQSQIHHPLPPTHHNNNNSFSNLLSPKPLLMKQSGVAGSCFAYGSGVPSKPTKLYRGVRQRHWGKWVAEIRLPRNRTRLWLGTFDTAEEAALAYDKAAYKLRGDFARLNFPNLRHNGFHIGGDFGEYKPLHSSVDAKLEAICKSMAETQKQDKSTKSSKKREKKVSSPDLSEKVKAEENSVSIGGSPPVTEFEESTAGSSPLSDLTFADPEEPPQWNETFSLEKYPSYEIDWDSILA

SEQ ID NO: 1949 - DNA, 1246 bp, Arabidopsis thaliana
  G9  Predicted polypeptide sequence is paralogous to G867, G1930
gtgtttcttctttctgctaaaaggttataatttttgtttcttggtttggtgagaatcttcaagaaactgaaacaaagaaaatggattctagttgcatagacgagataagttcctccacttcagaatctttctccgccaccaccgccaagaagctctctcctcctcccgcggcggcgttacgcctctaccggatgggaagcggcgggagcagcgtcgtgttggatcccgagaacggcctagagacggagtcacgaaagctaccatcttcaaaatacaaaggtgttgttcctcagcctaacggaagatggggagctcagatctacgagaagcaccaacgagtatggctcgggactttcaacgagcaagaagaagctgctcgttcctacgacatcgcagcttgtagattccgtggccgcgacgccgtcgtcaacttcaagaacgttctggaagacggcgatttagcttttcttgaagctcactcaaaggccgagatcgtcgacatgttgagaaaacacacttacgccgacgagcttgaacagaacaataaacggcagttgtttctctccgtcgacgctaacggaaaacgtaacggatcgagtactactcaaaacgacaaagttttaaagacgtgtgaagttcttttcgagaaggctgttacacctagcgacgttgggaagctaaaccgtctcgtgatacctaaacaacacgccgagaaacactttccgttaccgtcaccgtcaccggcagtgactaaaggagttttgatcaacttcgaagacgttaacggtaaagtgtggaggttccgttactcatactggaacagtagtcaaagttacgtgttgaccaagggatggagtcgattcgtcaaggagaagaatcttcgagccggtgatgttgttactttcgagagatcgaccggactagagcggcagttatatattgattggaaagttcggtctggtccgagagaaaacccggttcaggtggtggttcggcttttcggagttgatatctttaatgtgaccaccgtgaagccaaacgacgtcgtggccgtttgcggtggaaagagatctcgagatgttgatgatatgtttgcgttacggtgttccaagaagcaggcgataatcaatgctttgtgacatatttccttttccgattttatgctttcgttttttaatttttttttttgtcaagttgtgtaggttgtgattcatgctaggttgtatttaggaaaagagataagacc

SEQ ID NO: 1950 - protein, 352 aa, Arabidopsis thaliana
  G9  Paralogous to G867, G1930
MDSSCIDEISSSTSESFSATTAKKLSPPPAAALRLYRMGSGGSSVVLDPENGLETESRKLPSSKYKGVVPQPNGRWGAQIYEKHQRVWLGTFNEQEEAARSYDIAACRFRGRDAVVNFKNVLEDGDLAFLEAHSKAEIVDMLRKHTYADELEQNNKRQLFLSVDANGKRNGSSTTQNDKVLKTCEVLFEKAVTPSDVGKLNRLVIPKQHAEKHFPLPSPSPAVTKGVLINFEDVNGKVWRFRYSYWNSSQSYVLTKGWSRFVKEKNLRAGDVVTFERSTGLERQLYIDWKVRSGPRENPVQVVVRLFGVDIFNVTTVKPNDVVAVCGGKRSRDVDDMFALRCSKKQAIINAL

SEQ ID NO: 1951 - DNA, 831 bp, Arabidopsis thaliana
  G12  Predicted polypeptide sequence is paralogous to G24
gtgtcggtgaattttttgaaacttcttctcttttgcggtttcgtgttccactcctctcttcttggcccacgtgttcatcaatctctccctccgcatgtaatcgcttcgccgtcaatatcacatctttcttcttctttatctttaaaatctctttagatcgattcttttgtggattcttgaaatctccggagaaaaccactatggagacggcgactgaagtggccacggtggtgtcaactccggcggttacggttgcggcggtggcgacgaggaagagagataagccgtataaagggataaggatgaggaagtgggggaagtgggtggcggagataagagagcctaataaaaggtcaaggatctggcttggctcttactctactcctgaagcggcggcgcgtgcttacgacacggcggtgttttatctccgaggtccttctgctcggcttaacttcccggagcttttagccggagtgacggtgacgggaggaggcggaggaggagtgaacggtggtggagatatgtcggcggcgtatataaggagaaaagcggcggaggttggagcacaagtggatgcgttagaagcggcgggggcgggagggaatcgtcatcatcatcatcatcaacatcaacgtggtaatcatgattacgtagataatcatagtgattatcgtattaatgatgatcttatggagtgtagtagtaaagaagggtttaagaggtgtaatggatcgttggaacgggttgatttaaacaaattacccgatccggaaacttcagatgacgattaggaaagcaaaaaatagaaacaaaaaaaaaaaaaaaaaaaaa

SEQ ID NO: 1952 - protein, 196 aa, Arabidopsis thaliana
  G12  Paralogous to G24
METATEVATVVSTPAVTVAAVATRKRDKPYKGIRMRKWGKWVAEIREPNKRSRIWLGSYSTPEAAARAYDTAVFYLRGPSARLNFPELLAGVTVTGGGGGGVNGGGDMSAAYIRRKAAEVGAQVDALEAAGAGGNRHHHHHQHQRGNHDYVDNHSDYRINDDLMECSSKEGFKRCNGSLERVDLNKLPDPETSDDD

SEQ ID NO: 1953 - DNA, 553 bp, Arabidopsis thaliana
  G30  Predicted polypeptide sequence is paralogous to G1792
ctcttctgacgcacaacagtatatacacatacacagatatatggatcaaggaggtcgtagcagtggtagtggaggaggaggagccgagcaagggaagtaccgtggagtaaggagacgaccttggggtaaatacgccgcggaaataagagattcgaggaagcacggagagcgtgtgtggctagggacattcgacactgcggaagacgcggctcgagcctatgaccgagccgcctattcaatgagaggcaaagctgccattctcaacttccctcacgagtataacatgggaaccggatcctcatccactgcggctaattcttcttcctcgtcgcagcaagtttttgagtttgagtacttggacgatagcgttttggatgaacttcttgaatatggagagaactataacaagactcataatatcaacatgggcaagaggcaataaagggaatacaatcggtattaactgaaagttatgtgaaagaccattttcagttataacaaataaaataaaatcccaagcgtacaaagctgtttctaaaaaaaaaaaaaaaaa

SEQ ID NO: 1954 - protein, 133 aa, Arabidopsis thaliana
  G30  Paralogous to G1792
MDQGGRSSGSGGGGAEQGKYRGVRRRPWGKYAAEIRDSRKHGERVWLGTFDTAEDAARAYDRAAYSMRGKAAILNFPHEYNMGTGSSSTAANSSSSSQQVFEFEYLDDSVLDELLEYGENYNKTHNINMGKRQ

SEQ ID NO: 1955 - DNA, 929 bp, Arabidopsis thaliana
  G40  Predicted polypeptide sequence is paralogous to G912, G913
cttgaaaaagaatctacctgaaaagaaaaaaaagagagagagatataaatagctttaccaagacagatatactatcttttattaatccaaaaagactgagaactctagtaactacgtactacttaaaccttatccagtttcttgaaacagagtactctgatcaatgaactcattttcagctttttctgaaatgtttggctccgattacgagcctcaaggcggagattattgtccgacgttggccacgagttgtccgaagaaaccggcgggccgtaagaagtttcgtgagactcgtcacccaatttacagaggagttcgtcaaagaaactccggtaagtgggtttctgaagtgagagagccaaacaagaaaaccaggatttggctcgggactttccaaaccgctgagatggcagctcgtgctcacgacgtcgctgcattagccctccgtggccgatcagcatgtctcaacttcgctgactcggcttggcggctacgaatcccggagtcaacatgcgccaaggatatccaaaaagcggctgctgaagcggcgttggcttttcaagatgagacgtgtgatacgacgaccacgaatcatggcctggacatggaggagacgatggtggaagctatttatacaccggaacagagcgaaggtgcgttttatatggatgaggagacaatgtttgggatgccgactttgttggataatatggctgaaggcatgcttttaccgccgccgtctgttcaatggaatcataattatgacggcgaaggagatggtgacgtgtcgctttggagttactaatattcgatagtcgtttccatttttgtactatagtttgaaaatattctagttcctttttttagaatggttccttcattttattttattttattgttgtagaaacgagtggaaaataattcaatac

SEQ ID NO: 1956 - protein, 213 aa, Arabidopsis thaliana
  G40  Paralogous to G912, G913
MNSFSAFSEMFGSDYEPQGGDYCPTLATSCPKKPAGRKKFRETRHPIYRGVRQRNSGKWVSEVREPNKKTRIWLGTFQTAEMAARAHDVAALALRGRSACLNFADSAWRLRIPESTCAKDIQKAAAEAALAFQDETCDTTTTNHGLDMEETMVEAIYTPEQSEGAFYMDEETMFGMPTLLDNMAEGMLLPPPSVQWNHNYDGEGDGDVSLWSY

SEQ ID NO: 1957 - DNA, 803 bp, Arabidopsis thaliana
  G41  Predicted polypeptide sequence is paralogous to G912, G913
ctgatcaatgaactcattttctgccttttctgaaatgtttggctccgattacgagtctccggtttcctcaggcggtgattacagtccgaagcttgccacgagctgccccaagaaaccagcgggaaggaagaagtttcgtgagactcgtcacccaatttacagaggagttcgtcaaagaaactccggtaagtgggtgtgtgagttgagagagccaaacaagaaaacgaggatttggctcgggactttccaaaccgctgagatggcagctcgtgctcacgacgtcgccgccatagctctccgtggcagatctgcctgtctcaatttcgctgactcggcttggcggctacgaatcccggaatcaacctgtgccaaggaaatccaaaaggcggcggctgaagccgcgttgaattttcaagatgagatgtgtcatatgacgacggatgctcatggtcttgacatggaggagaccttggtggaggctatttatacgccggaacagagccaagatgcgttttatatggatgaagaggcgatgttggggatgtctagtttgttggataacatggccgaagggatgcttttaccgtcgccgtcggttcaatggaactataattttgatgtcgagggagatgatgacgtgtccttatggagctattaaaattcgatttttatttccatttttggtattatagctttttatacatttgatccttttttagaatggatcttcttctttttttggttgtgagaaacgaatgtaaatggtaaaagttgttgtcaaatgcaaatgtttttgagtgcag

SEQ ID NO: 1958 - protein, 207 aa, Arabidopsis thaliana
  G41  Paralogous to G912, G913
MFGSDYESPVSSGGDYSPKLATSCPKKPAGRKKFRETRHPIYRGVRQRNSGKWVCELREPNKKTRIWLGTFQTAEMAARAHDVAAIALRGRSACLNFADSAWRLRIPESTCAKEIQKAAAEAALNFQDEMCHMTTDAHGLDMEETLVEAIYTPEQSQDAFYMDEEAMLGMSSLLDNMAEGMLLPSPSVQWNYNFDVEGDDDVSLWSY

SEQ ID NO: 1959 - DNA, 908 bp, Arabidopsis thaliana
  G42  Predicted polypeptide sequence is paralogous to G912, G913
  misc_feature (851)..(851): n is a, c, g, or t
cctgaactagaacagaaagagagagaaactattatttcagcaaaccataccaacaaaaaagacagagatcttttagttaccttatccagtttcttgaaacagagtactcttctgatcaatgaactcattttctgctttttctgaaatgtttggctccgattacgagtcttcggtttcctcaggcggtgattatattccgacgcttgcgagcagctgccccaagaaaccggcgggtcgtaagaagtttcgtgagactcgtcacccaatatacagaggagttcgtcggagaaactccggtaagtgggtttgtgaggttagagaaccaaacaagaaaacaaggatttggctcggaacatttcaaaccgctgagatggcagctcgagctcacgacgttgccgctttagcccttcgtggccgatcagcctgtctcaatttcgctgactcggcttggagactccgaatcccggaatcaacttgcgctaaggacatccaaaaggcggcggctgaagctgcgttggcgtttcaggatgagatgtgtgatgcgacgacggatcatggcttcgacatggaggagacgttggtggaggctatttacacggcggaacagagcgaaaatgcgttttatatgcacgatgaggcgatgtttgagatgccgagtttgttggctaatatggcagaagggatgcttttgccgcttccgtccgtacagtggaatcataatcatgaagtcgacggcgatgatgacgacgtatcgttatggagttattaaaactcagattattatttccatttttagtacgatactttttattttattattatttttagatccttttttagaatggaatctncattatgtttgtaaaactgagaaacgagtgtaaattaaattgattcagtttcagtat

SEQ ID NO: 1960 - protein, 216 aa, Arabidopsis thaliana
  G42  Paralogous to G912, G913
MNSFSAFSEMFGSDYESSVSSGGDYIPTLASSCPKKPAGRKKFRETRHPIYRGVRRRNSGKWVCEVREPNKKTRIWLGTFQTAEMAARAHDVAALALRGRSACLNFADSAWRLRIPESTCAKDIQKAAAEAALAFQDEMCDATTDHGFDMEETLVEAIYTAEQSENAFYMHDEAMFEMPSLLANMAEGMLLPLPSVQWNHNHEVDGDDDDVSLWSY

SEQ ID NO: 1961 - DNA, 1454 bp, Arabidopsis thaliana
  G182  Predicted polypeptide sequence is paralogous to G196
cgtcgacgatcagattcttgcgtatagctgtatatatacaccaagatacactcatcatcgtcatatatagattatgtgcagcgtctctgagcttcttgacatggaaaacttccaaggagacttaaccgacgtcgtacgaggaatcggaggccacgtgttatcaccggagactcctccctcgaacatctggcctcttcctctgtcacatccaacaccatcaccgtcagatcttaacataaaccccttcggagatccctttgtgagcatggacgatccactcctccaagaactaaactccatcacaaactccggctatttctccaccgtaggagataacaacaacaacattcacaacaacaatggtttcttggttccaaaggtatttgaggaggatcatataaagagtcaatgtagtatcttcccaagaatccggatctcgcatagtaacatcatccacgattcttctccgtgtaattctccggccatgtcggctcacgttgtcgcagccgcagcagccgcctcgccgagaggcatcatcaacgtagacacaaacagtcctagaaactgtctattggttgatggtaccacgttctcctcgcagattcagatatcttcccctcggaatctaggccttaaaagaaggaagagtcaggcaaagaaggtggtgtgtattccggccccggctgcaatgaacagccgatcaagcggagaagtggttccatcggatctatgggcttggcgtaaatacggtcaaaaacctatcaaaggctctccttttccaaggggttattatagatgcagcagctcaaaaggttgttcagcaagaaagcaagtcgaaagaagccgaaccgatccaaacatgttggtgattacatatacctccgaacataaccatccttggcccatccaacgcaacgctctcgccggctccacacgctcctccacctcctcctcatctaaccctaatccttccaaaccctcaaccgcaaacgtaaactcctcatccattggctcccaaaacaccatctacttgccttcctccaccactcctcctcctaccctctcatcctccgccatcaaagatgaacgaggggacgatatggagttggaaaacgtagatgatgatgatgataaccagattgctccatacagaccggagcttcatgatcatcagcaccaaccagatgatttctttgcagatcttgaagagctagaaggagattctctaagcatgttgctttctcatggctgtggcggcgacgggaaggataaaacgaccgcgtccgatgggatcagcaatttcttcgggtggtcgggagataataattataataattacgacgaccaagactcaaggtcgttatagtatagtgttaattacaggtaaacaaattatattaaattaagttgagcttgtgaaaatgaagatcatatggtctggtcaggttgggggc

SEQ ID NO: 1962 - protein, 430 aa, Arabidopsis thaliana
  G182  Paralogous to G196
MCSVSELLDMENFQGDLTDVVRGIGGHVLSPETPPSNIWPLPLSHPTPSPSDLNINPFGDPFVSMDDPLLQELNSITNSGYFSTVGDNNNNIHNNNGFLVPKVFEEDHIKSQCSIFPRIRISHSNIIHDSSPCNSPAMSAHVVAAAAAASPRGIINVDTNSPRNCLLVDGTTFSSQIQISSPRNLGLKRRKSQAKKVVCIPAPAAMNSRSSGEVVPSDLWAWRKYGQKPIKGSPFPRGYYRCSSSKGCSARKQVERSRTDPNMLVITYTSEHNHPWPIQRNALAGSTRSSTSSSSNPNPSKPSTANVNSSSIGSQNTIYLPSSTTPPPTLSSSAIKDERGDDMELENVDDDDDNQIAPYRPELHDHQHQPDDFFADLEELEGDSLSMLLSHGCGGDGKDKTTASDGISNFFGWSGDNNYNNYDDQDSRSL

SEQ ID NO: 1963 - DNA, 825 bp, Arabidopsis thaliana
  G197  Predicted polypeptide sequence is paralogous to G664
atgggaaggtctccttgctgtgagaaagaccacacaaacaaaggagcttggactaaggaagaagacgataagctcatctcttacatcaaagctcacggtgaaggttgttggcgttctcttcctagatccgccggtcttcaacgttgcggaaaaagctgtcgtctccgatggattaactatctccgacctgatctcaagaggggtaacttcaccctcgaagaagatgatctcatcatcaaactacatagccttctcggtaacaagtggtctcttattgcgacgagattaccaggaagaacagataacgagattaagaattactggaacacacatgttaagaggaagctattaagaaaagggattgatccggcgactcatcgacctatcaacgagaccaaaacttctcaagattcgtctgattctagtaaaacagaggaccctcttgtcaagattctctcttttggtcctcagctggagaaaatagcaaatttcggggacgagagaattcaaaagagagttgagtactcagttgttgaagaaagatgtctggacttgaatcttgagcttaggatcagtccaccatggcaagacaagctccatgatgagaggaacctaaggtttgggagagtgaagtataggtgcagtgcgtgccgttttggattcgggaacggcaaggagtgtagctgtaataatgtgaaatgtcaaacagaggacagtagtagcagcagttattcttcaaccgacattagtagtagcattggttatgacttcttgggtctaaacaacactagggttttggattttagcactttggaaatgaaatga

SEQ ID NO: 1964 - protein, 274 aa, Arabidopsis thaliana
  G197  Paralogous to G664
MGRSPCCEKDHTNKGAWTKEEDDKLISYIKAHGEGCWRSLPRSAGLQRCGKSCRLRWINYLRPDLKRGNFTLEEDDLIIKLHSLLGNKWSLIATRLPGRTDNEIKNYWNTHVKRKLLRKGIDPATHRPINETKTSQDSSDSSKTEDPLVKILSFGPQLEKIANFGDERIQKRVEYSVVEERCLDLNLELRISPPWQDKLHDERNLRFGRVKYRCSACRFGFGNGKECSCNNVKCQTEDSSSSSYSSTDISSSIGYDFLGLNNTRVLDFSTLEMK

SEQ ID NO: 1965 - DNA, 687 bp, Arabidopsis thaliana
  G212  Predicted polypeptide sequence is paralogous to G676
atgagaataaggagaagagatgaaaaagagaatcaagaatacaagaaaggtttatggacagttgaagaagacaacatccttatggactatgttcttaatcatggcactggccaatggaaccgcatcgtcagaaaaactgggctaaagagatgtgggaaaagttgtagactgagatggatgaattatttgagccctaatgtgaacaaaggcaatttcactgaacaagaagaagacctcattattcgtctccacaagctcctcggcaatagatggtctttgatagctaaaagagtaccgggaagaacagataaccaagtcaagaactactggaacactcatctcagcaaaaaactcgtcggagattactcctccgccgtcaaaaccaccggagaagacgacgactctccaccgtcattgttcatcactgccgccacaccttcttcttgtcatcatcaacaagaaaatatctacgagaatatagccaagagctttaacggcgtcgtatcagcttcgtacgaggataaaccaaaacaagaactggctcaaaaagatgtcctaatggcaactactaatgatccaagtcactattatggcaataacgctttatgggttcatgacgacgattttgagcttagttcactcgtaatgatgaattttgcttctggtgatgttgagtactgcctttag

SEQ ID NO: 1966 - protein, 228 aa, Arabidopsis thaliana
  G212  Paralogous to G676
MRIRRRDEKENQEYKKGLWTVEEDNILMDYVLNHGTGQWNRIVRKTGLKRCGKSCRLRWMNYLSPNVNKGNFTEQEEDLIIRLHKLLGNRWSLIAKRVPGRTDNQVKNYWNTHLSKKLVGDYSSAVKTTGEDDDSPPSLFITAATPSSCHHQQENIYENIAKSFNGVVSASYEDKPKQELAQKDVLMATTNDPSHYYGNNALWVHDDDFELSSLVMMNFASGDVEYCL

SEQ ID NO: 1967 - DNA, 1104 bp, Arabidopsis thaliana
  G216  Predicted polypeptide sequence is paralogous to G2719
atgaacggagaaatctctcgtccgccggagctaatatcgtcccggaatccttgcaagagttttgaaaatgcaatacacaaagcagttgaggcagagctcgccgagctagcgaaaagcgacgcgaacggcggcggaaagagtaaagtgaaaggaccttggttgccggagcaagatgaggctctcacgaggcttgtgaaaatgtgtgggccgaggaactggaatctaatctcccgtggaatcccaggtcgctctggtaaatcttgccgattacgttggtgtaatcagctcgatcctatcctcaaacgaaaacctttctctgatgaggaggagcatatgataatgtctgcacaggcggttcttgggaacaaatggtctgtgattgctaaactcttacctgggagaacagataatgccattaagaatcattggaactctaatcttagacgtaaaccagcagaacaatggaagattcctctattgatgtctaatacagagatagtatatcaactgtatccatcaatggtcagaaggatatcaaacgcatcccccaaagaacatctacctcaagaagaagaaaccggtgtattaagtgatgataaaatggatgatgaagcaaaggagcctcctcgggagcaaaatagtaaaactggtgtttatcgtccagtggctcgaatgggtgctttcagtgtctgtaaaccaggatacatggctccatgtgagggacctttggttcaagcatcaagacctgactcattggctggtaaatttcttcagtctctttgttatgatcctattatcccttcaaaatgcggtcacggttgctgcaaccatcaagacagcacaacactgtcatcatcgtcggtgctgggatcagagtttgtggattatgaggaacattcttctgcagagttagataaagaattgatctctatatcaaatgacctgaacaatactgcttggattaggagtgggaaggaagctgaacagagtttgaaggctgatgatcagtttcgtcgtgagtatgctcactcgaaatttagtggaatggtaaacaatggtgtatcaagtcagatggtgagacaagatttaagggctttgagctaa

SEQ ID NO: 1968 - protein, 367 aa, Arabidopsis thaliana
  G216  Paralogous to G2719
MNGEISRPPELISSRNPCKSFENAIHKAVEAELAELAKSDANGGGKSKVKGPWLPEQDEALTRLVKMCGPRNWNLISRGIPGRSGKSCRLRWCNQLDPILKRKPFSDEEEHMIMSAQAVLGNKWSVIAKLLPGRTDNAIKNHWNSNLRRKPAEQWKIPLLMSNTEIVYQLYPSMVRRISNASPKEHLPQEEETGVLSDDKMDDEAKEPPREQNSKTGVYRPVARMGAFSVCKPGYMAPCEGPLVQASRPDSLAGKFLQSLCYDPIIPSKCGHGCCNHQDSTTLSSSSVLGSEFVDYEEHSSAELDKELISISNDLNNTAWIRSGKEAEQSLKADDQFRREYAHSKFSGMVNNGVSSQMVRQDLRALS

SEQ ID NO: 1969 - DNA, 1033 bp, Arabidopsis thaliana
  G221  Predicted polypeptide sequence is paralogous to G1322
ctctcttattctctcactcttttttttttatattcctctctctctaaatctataaaatatatttaaaaacttgatcgtatataataaagtaaataaagaataataacaaaaaaaatggagaaaagaggaggaggaagtagtggaggttcgggatcatcagcagaagcagaagtgagaaaaggaccatggacgatggaagaagatcttattcttatcaactatatcgccaaccacggcgatggtgtttggaattctctcgccaaatctgcaggtctaaaacgaaccgggaaaagttgccggctccggtggctgaactatctccgccccgacgtacgacggggaaacatcactccagaagagcaacttatcatcatggaacttcatgctaagtggggaaacaggtggtcgaaaatcgccaaacatcttccaggaagaacggacaacgagatcaaaaatttctgtaggacaagaattcaaaaatacatcaagcaatcggatgtaacaacaacatcgtccgttggatctcatcatagctcagagatcaacgatcaagctgcaagcacgtcgagccataatgtcttttgtacacaagatcaagcgatggagacttattctcctacaccgacatcatatcaacataccaatatggaattcaactatggtaactattcggccgcggcagtgacggcaaccgtggattatccagtaccgatgaccgttgatgatcaaaccggtgaaaactattggggcatggatgatatttggtcatcaatgcatttattgaatggtaattgattgatcggtggacaaaacatggaatattaattgagtattatatatgatttttaggagtactattattagtacgtgacatgtatatgtttttgcctcgttgtagaggtttggggttataattaatatataatgttatctaatatgcaaccttgatacatatttggatctttattgaacccatgttatacataaataaaattgttgaaggggtcataaaaaaaaaaaaaaaaaaaaaaaa

SEQ ID NO: 1970 - protein, 226 aa, Arabidopsis thaliana
  G221  Paralogous to G1322
MEKRGGGSSGGSGSSAEAEVRKGPWTMEEDLILINYIANHGDGVWNSLAKSAGLKRTGKSCRLRWLNYLRPDVRRGNITPEEQLIIMELHAKWGNRWSKIAKHLPGRTDNEIKNFCRTRIQKYIKQSDVTTTSSVGSHHSSEINDQAASTSSHNVFCTQDQAMETYSPTPTSYQHTNMEFNYGNYSAAAVTATVDYPVPMTVDDQTGENYWGMDDIWSSMHLLNGN

SEQ ID NO: 1971 - DNA, 584 bp, Arabidopsis thaliana
  G225  Predicted polypeptide sequence is paralogous to G226, G682
ctctctctctcactcttttcttttccgagaacccaacaaaaaaaaagctactattaatccttcccctcgtgaggaaatcatttcttcttgtttctcgagatttattctctttctctctctctttctctgtgtgtttcgtgtcttcagattagttcgatgtttcgttcagacaaggcggaaaaaatggataaacgacgacggagacagagcaaagccaaggcttcttgttccgaagaggtgagtagtatcgaatgggaagctgtgaagatgtcagaagaagaagaagatctcatttctcggatgtataaactcgttggcgacaggtgggagttgatcgccggaaggatcccgggacggacgccggaggagatagagagatattggcttatgaaacacggcgtcgtttttgccaacagacgaagagacttttttaggaaatgattttttttgtttggattaaaagaaaattttcctctccttaattcacaagacaagaaaaaaaggaaatgtacctgtccttgaattactattttggaatgtataattatctatatatataagaagaaaaaattgcttaggaattt

SEQ ID NO: 1972 - protein, 94 aa, Arabidopsis thaliana
  G225  Paralogous to G226, G682
MFRSDKAEKMDKRRRRQSKAKASCSEEVSSIEWEAVKMSEEEEDLISRMYKLVGDRWELIAGRIPGRTPEEIERYWLMKHGVVFANRRRDFFRK

SEQ ID NO: 1973 - DNA, 489 bp, Arabidopsis thaliana
  G228  Predicted polypeptide sequence is paralogous to G254
atggtgactgtaaaccctagccaagctcattgtttgcctatgaaaatgagtctaccgggtttcaatactcttccccacacggcaacaacgataccggtttccatacggagcaataggacgatgtcgttttttgaggatccaacaaagaaggttagaaagccttacactatcaccaaatctagagagaactggacggagcaagaacacgacaagttccttgaagcccttcatctatttgaccgggattggaagaaaataaaggcctttgttggatcaaaaacagtgatacagatacgaagccacgcacagaagtactttctcaaagttcagaagaatgggactaaagaacatctcccacctcctcgaccaaagaggaaagccaatcacccatatccacaaaaagctcctaaatgtggcaaccttaaaccttttatctttctacttccgcttttgttactttatctcattttctcatggttatgtttttga

SEQ ID NO: 1974 - protein, 162 aa, Arabidopsis thaliana
  G228  Paralogous to G254
MVTVNPSQAHCLPMKMSLPGFNTLPHTATTIPVSIRSNRTMSFFEDPTKKVRKPYTITKSRENWTEQEHDKFLEALHLFDRDWKKIKAFVGSKTVIQIRSHAQKYFLKVQKNGTKEHLPPPRPKRKANHPYPQKAPKCGNLKPFIFLLPLLLLYLIFSWLCF

SEQ ID NO: 1975 - DNA, 916 bp, Arabidopsis thaliana
  G231  Predicted polypeptide sequence is paralogous to G2007
ttccatatctcttccatttcgctctctatttcacatccccatataacataatatacaatcacacatatcatttctatatagtatttaatggggagacagccatgctgtgacaagctaggggtgaagaaagggccgtggacggtggaggaagataagaagcttataaacttcatactaaccaatggccattgttgctggcgtgctttgccgaagctggccggtctccgtcgctgtggaaagagctgccgcctccggtggactaactatctccggcctggcttaaaacgaggccttctctcgcatgatgaagaacaacttgtcatagatcttcatgctaatctcggcaataagtggtctaagatagcttcaagattacctggaagaacagataacgaaataaaaaaccattggaatactcatatcaagaagaaacttcttaagatgggaatcgatcctatgacccatcaacccctaaatcaagaaccttctaatatcgataattccaaaaccattccgtccaatccagacgatgtctcagtggaaccaaagacaactaacacgaaatacgtggagataagtgtcacgacaacagaagaagaaagtagtagcacggttactgatcaaaacagttcgatggataatgaaaatcatctaattgacaacatttatgatgatgatgaattgtttagttacttatggtccgacgaaactactaaagatgaggcctcttggagtgatagtaactttggtgttggtggaacattatatgaccacaatatctccggcgccgatgcagattttccgatatggtcaccggaaagaatcaatgacgagaagatgtttttggattattgtcaagactttggtgttcatgattttgggttttgactgttcaccattgacatattggcaacgc

SEQ ID NO: 1976 - protein, 266 aa, Arabidopsis thaliana
  G231  Paralogous to G2007
MGRQPCCDKLGVKKGPWTVEEDKKLINFILTNGHCCWRALPKLAGLRRCGKSCRLRWTNYLRPGLKRGLLSHDEEQLVIDLHANLGNKWSKIASRLPGRTDNEIKNHWNTHIKKKLLKMGIDPMTHQPLNQEPSNIDNSKTIPSNPDDVSVEPKTTNTKYVEISVTTTEEESSSTVTDQNSSMDNENHLIDNIYDDDELFSYLWSDETTKDEASWSDSNFGVGGTLYDHNISGADADFPIWSPERINDEKMFLDYCQDFGVHDFGF

SEQ ID NO: 1977 - DNA, 1046 bp, Arabidopsis thaliana; identical to SEQ ID NO: 39
  G233  Predicted polypeptide sequence is paralogous to G241

SEQ ID NO: 1978 - protein, 273 aa, Arabidopsis thaliana; identical to SEQ ID NO: 40
  G233  Paralogous to G241

SEQ ID NO: 1979 - DNA, 660 bp, Arabidopsis thaliana
  G247  Predicted polypeptide sequence is paralogous to G676
atgagaatgacaagagatggaaaagaacatgaatacaagaaaggtttatggacagtggaagaagacaagatcctcatggattatgtccgaactcatggccagggccactggaaccgcatcgccaagaaaactgggctcaagagatgtgggaaaagctgtaggttgagatggatgaactacttaagccctaatgttaacagaggcaattttactgaccaagaagaagatctcatcatcagactccacaagctcctcggcaacagatggtcgttgatagcgaaaagagttccgggaagaacagacaaccaagtaaagaattactggaacacacatctcagcaagaaacttggtctcggagatcattcaactgccgtcaaagccgcatgcggtgtagagtctccaccgtctatggcccttataaccacaacgtcctcctctcatcaagagatctccggtggaaaaaattcaactctaaggttcgacactttagttgacgaatccaaactcaaaccaaaatccaaactagtccacgcaacaccaactgacgtagaagttgcagctacggttccaaatctgttcgataccttttgggttcttgaagacgacttcgagcttagttcactcactatgatggattttactaatgggtattgcctttga

SEQ ID NO: 1980 - protein, 219 aa, Arabidopsis thaliana
  G247  Paralogous to G676
MRMTRDGKEHEYKKGLWTVEEDKILMDYVRTHGQGHWNRIAKKTGLKRCGKSCRLRWMNYLSPNVNRGNFTDQEEDLIIRLHKLLGNRWSLIAKRVPGRTDNQVKNYWNTHLSKKLGLGDHSTAVKAACGVESPPSMALITTTSSSHQEISGGKNSTLRFDTLVDESKLKPKSKLVHATPTDVEVAATVPNLFDTFWVLEDDFELSSLTMMDFTNGYCL

SEQ ID NO: 1981 - DNA, 731 bp, Arabidopsis thaliana
  G249  Predicted polypeptide sequence is paralogous to G1322
ccgccgacatggagaaaagagaaagtagtggtgggtctggatcaggagatgcagaggtgagaaaagggccatggacgatggaagaagatttgattctcatcaattatatcgccaatcatggtgaaggtgtttggaactctctcgccaaatctgcaggactaaaacgcaccgggaaaagttgccggctccggtggctgaactacctccgacctgatgcgcgacggggaaatatcacaccagaagaacagctcaccatcatggaacttcatgcaaaatggggaaataggtggtcaaaaattgcaaagcatttaccaggaagaaccgacaatgagataaagaatttttggaggactaagatccagaaatacatcatcaagagcggagaaacgacgaccgttggatcacaaagctccgagtttataaaccatcatgcgacaacgagccatgtcatgaatgatactcaagaaaccatggatatgtattctccaacgacgtcgtatcaacatgccagcaatattaatcagcagcttaattatggtaattatgtgcctgaatccggttcgatcatgatgccattatctgttgatcagtccgaacaaaactattggagcgtcgatgatctttggcccatgaatatatataatggtaattaataaataagttcgttaaaacttatatatatttacggtccaaagagggttctatataaacagagtactgtatgggattgc

SEQ ID NO: 1982 - protein, 214 aa, Arabidopsis thaliana
  G249  Paralogous to G1322
MEKRESSGGSGSGDAEVRKGPWTMEEDLILINYIANHGEGVWNSLAKSAGLKRTGKSCRLRWLNYLRPDARRGNITPEEQLTIMELHAKWGNRWSKIAKHLPGRTDNEIKNFWRTKIQKYIIKSGETTTVGSQSSEFINHHATTSHVMNDTQETMDMYSPTTSYQHASNINQQLNYGNYVPESGSIMMPLSVDQSEQNYWSVDDLWPMNIYNGN

SEQ ID NO: 1983 - DNA, 918 bp, Arabidopsis thaliana
  G255  Predicted polypeptide sequence is paralogous to G664
agcatcatcatcatcagaagaagagagtcatgggaagatctccttgctgcgagaaagaacacatgaacaaaggtgcttggactaaagaagaagatgagagactagtctcttacatcaagtctcacggtgaaggttgttggcgatctcttcctagagccgctggtctccttcgctgcggtaaaagctgccgtcttcggtggattaactatctccgacctgatctcaaaagaggaaactttacacatgatgaagatgaacttatcatcaagcttcatagcctcctaggcaacaagtggtctttgattgcggcgagattacctggaagaacagataacgagatcaagaactactggaacacacatataaagaggaagcttttgagcaaagggattgatccagccactcatagagggatcaacgaggcaaaaatttctgatttgaagaaaacaaaggaccaaattgtaaaagatgtttcttttgtgacaaagtttgaggaaacagacaagtctggggaccagaagcaaaataagtatattcgaaatgggttagtttgcaaagaagagagagttgttgttgaagaaaaaataggcccagatttgaatcttgagcttaggatcagtccaccatggcaaaaccagagagaaatatctacttgcactgcgtcccgtttttacatggaaaacgacatggagtgtagtagtgaaactgtgaaatgtcaaacagagaatagtagcagcattagctattcttctattgatattagtagtagtaacgttggttatgacttcttgggtttgaagacaagaattttggattttcgaagcttggaaatgaaataaatgaatagtattagattcttaatttgtaggtctgataatgaatgttagattcgcggccctctagacaggcctcgtaccg

SEQ ID NO: 1984 - protein, 269 aa, Arabidopsis thaliana
  G255  Paralogous to G664
MGRSPCCEKEHMNKGAWTKEEDERLVSYIKSHGEGCWRSLPRAAGLLRCGKSCRLRWINYLRPDLKRGNFTHDEDELIIKLHSLLGNKWSLIAARLPGRTDNEIKNYWNTHIKRKLLSKGIDPATHRGINEAKISDLKKTKDQIVKDVSFVTKFEETDKSGDQKQNKYIRNGLVCKEERVVVEEKIGPDLNLELRISPPWQNQREISTCTASRFYMENDMECSSETVKCQTENSSSISYSSIDISSSNVGYDFLGLKTRILDFRSLEMK

SEQ ID NO: 1985 - DNA, 723 bp, Arabidopsis thaliana
  G342  Predicted polypeptide sequence is paralogous to G343
atggacgtctacggcatgtcttcaccggacttgcttcgtatcgacgaccttctcgatttctccaacgacgaaatcttctcttcctcttccaccgtcacttcctccgccgcttcctccgccgcttcttccgaaaaccctttcagctttccttcttccacctacacttctcctactctcctcaccgacttcactcacgatctctgcgttcccagtgacgacgcagctcatctcgaatggttatcgcgattcgttgacgattcattctccgatttcccagcaaatcctttaaccatgaccgttagacccgagatttcattcaccggaaaacctagaagtcgccgatcaagagcaccagcaccttccgtagctggaacttgggctccgatgtctgaatcagagctttgtcactccgtcgctaaacctaaaccgaagaaagtctacaacgctgaatcggttacggcggatggagcgaggcggtgcacgcactgtgcctcggagaaaacgccacagtggagaactggaccgcttggacctaaaacactttgtaacgcttgtggagttcgttacaaatcagggaggcttgtaccggaatacagaccggcgtcgagtccgacgtttgtattgactcagcattcgaactctcatcggaaagttatggagctccggcgacagaaggaacaacaagaatcttgcgttcgaattccgccgtttcagccgcagtaa

SEQ ID NO: 1986 - protein, 240 aa, Arabidopsis thaliana
  G342  Paralogous to G343
MDVYGMSSPDLLRIDDLLDFSNDEIFSSSSTVTSSAASSAASSENPFSFPSSTYTSPTLLTDFTHDLCVPSDDAAHLEWLSRFVDDSFSDFPANPLTMTVRPEISFTGKPRSRRSRAPAPSVAGTWAPMSESELCHSVAKPKPKKVYNAESVTADGARRCTHCASEKTPQWRTGPLGPKTLCNACGVRYKSGRLVPEYRPASSPTFVLTQHSNSHRKVMELRRQKEQQESCVRIPPFQPQ

SEQ ID NO: 1987 - DNA, 1099 bp, Arabidopsis thaliana
  G350  Predicted polypeptide sequence is paralogous to G545
acagttgtacaaaaaagcaggcgtggtaccggaccggtaattcccggggatatcgtcgtacccacgcgtccgctcgacacgcaacttccttcctcttcagactcctctgactttactatatataacacacacactttcatttcttgtttcttcaaatcaaatcttttcatttacaattatctttcttctcaatttagaacttagtagctagtcttcaagataatggcacttgaaactcttacttctccaagattatcttctccgatgccgactctgtttcaagattcagcactagggtttcatggaagcaaaggcaaacgatctaagcgatcaagatctgaattcgaccgtcagagtctcacggaggatgaatatatcgctttatgtctcatgcttcttgctcgcgacggagatagaaaccgtgaccttgacctgccttcttcttcgtcttcacctcctctgcttcctcctcttcctactccgatctacaagtgtagcgtctgtgacaaggcgttttcgtcttaccaggctcttggtggacacaaggcaagtcaccggaaaagcttttcgcttactcaatctgccggaggagatgagctgtcgacatcgtcggcgataaccacgtctggtatatccggtggcgggggaggaagtgtgaagtcgcacgtttgctctatctgtcataaatcgttcgccaccggtcaagctctcggcggccacaaacggtgccactacgaaggaaagaacggaggcggtgtgagtagtagcgtgtcgaattctgaagatgtggggtctacaagccacgtcagcagtggccaccgtgggtttgacctcaacataccgccgataccggaattctcgatggtcaacggagacgaagaggtgatgagtcctatgccggcgaagaaactccggtttgacttcccggagaaaccctaaacataaacctaggaaaaactttacagaattcattttataggaaattgttttactgtatatacaaatatcgattttgattgatgttcttcttcactgaaaaattatgattctttgttgtatacttgatgtttctgaaaaagatataactttttattaaaaa

SEQ ID NO: 1988 - protein, 238 aa, Arabidopsis thaliana
  G350  Paralogous to G545
MALETLTSPRLSSPMPTLFQDSALGFHGSKGKRSKRSRSEFDRQSLTEDEYIALCLMLLARDGDRNRDLDLPSSSSSPPLLPPLPTPIYKCSVCDKAFSSYQALGGHKASHRKSFSLTQSAGGDELSTSSAITTSGISGGGGGSVKSHVCSICHKSFATGQALGGHKRCHYEGKNGGGVSSSVSNSEDVGSTSHVSSGHRGFDLNIPPIPEFSMVNGDEEVMSPMPAKKLRFDFPEKP

SEQ ID NO: 1989 - DNA, 889 bp, Arabidopsis thaliana
  G351  Predicted polypeptide sequence is paralogous to G545
ttttgactgatagtgacctgttcgttgcaacaaattgataagcaatgcttttttataatgccaactttgtacaaaaaagcaggctttaaaggaaccaattcagtcgacctcacgcaacttcctctcttctcaagattcttctccatacttcaccttcttctatatatctctctgctctcaaattaggttttaaattttctatagcaatggcgcttgaagctcttaattcaccaagattggtcgaggatcccttaagattcaatggcgttgagcagtggaccaaatgtaagaaacgatccaaacgttcgagatctgatcttcatcataaccaccgtctcactgaggaagagtatctagctttctgtctcatgcttcttgctcgggatggcggcgatcttgactctgtgacggttgcggagaagccgagttataagtgtggcgtttgttacaagacgttttcgtcttaccaagctctcggcggtcataaagcgagccaccggagcttatacggtggtggagagaatgataaatcgacaccatccaccgccgtgaaatctcacgtttgttcggtttgcgggaaatctttcgccaccggtcaagctctcggcggccacaagcggtgccactacgatggtggcgtttcgaactcggaaggtgtggggtctactagccacgtcagcagtagtagccaccgtggatttgaccttaatattataccggtgcagggattttcgccggacgacgaagtgatgagtccgatggcgactaagaagcctcgcctgaagtaagtctttgttgaagacctggaagtttatcaaatgtaaatatcaaatttcaatttcaaggaacagttttgttgattctattaccaatacacaatacggcggcc

SEQ ID NO: 1990 - protein, 193 aa, Arabidopsis thaliana
  G351  Paralogous to G545
MALEALNSPRLVEDPLRFNGVEQWTKCKKRSKRSRSDLHHNHRLTEEEYLAFCLMLLARDGGDLDSVTVAEKPSYKCGVCYKTFSSYQALGGHKASHRSLYGGGENDKSTPSTAVKSHVCSVCGKSFATGQALGGHKRCHYDGGVSNSEGVGSTSHVSSSSHRGFDLNIIPVQGFSPDDEVMSPMATKKPRLK

SEQ ID NO: 1991 - DNA, 774 bp, Arabidopsis thaliana
  G370  Predicted polypeptide sequence is paralogous to G361, G362
atggacgaaaccaacggacgaagagaaactcacgatttcatgaacgtcaacgttgaatccttctctcagcttcctttcatccgccgtactcctcccaaagaaaaagccgccattattcgtctcttcggccaagagctcgtcggtgataactccgacaacttatccgcagaaccttctgatcatcaaaccactaccaagaacgatgagagctctgagaatatcaaggacaaagacaaagaaaaagataaggacaaagacaaagataacaacaacaacaggagattcgagtgtcactactgcttcagaaacttcccaacttctcaagccctaggtggacatcaaaacgctcacaaacgtgaacgtcaacacgccaaacgcggttccatgacatcataccttcatcatcatcagcctcatgaccctcaccacatctacggcttcctcaacaaccaccaccaccgtcactatccgtcttggacgacggaagctagatcatactacggcggagggggacatcaaacgccgtcgtactactcaaggaatactcttgctcctccttcttctaacccaccgacaatcaacggaagtcctttaggtttgtggcgtgtaccgccttccacgtcaacaaatactattcaaggcgtttactcatcttcaccagcttcagcgtttaggtcgcatgagcaagagactaataaggagcctaataactggccgtacagattgatgaaacccaatgtgcaagatcatgtgagtctcgatcttcatctctga

SEQ ID NO: 1992 - protein, 257 aa, Arabidopsis thaliana
  G370  Paralogous to G361, G362
MDETNGRRETHDFMNVNVESFSQLPFIRRTPPKEKAAIIRLFGQELVGDNSDNLSAEPSDHQTTTKNDESSENIKDKDKEKDKDKDKDNNNNRRFECHYCFRNFPTSQALGGHQNAHKRERQHAKRGSMTSYLHHHQPHDPHHIYGFLNNHHHRHYPSWTTEARSYYGGGGHQTPSYYSRNTLAPPSSNPPTINGSPLGLWRVPPSTSTNTIQGVYSSSPASAFRSHEQETNKEPNNWPYRLMKPNVQDHVSLDLHL

SEQ ID NO: 1993 - DNA, 2502 bp, Arabidopsis thaliana
  G392  Predicted polypeptide sequence is paralogous to G390, G391, G438
atgggaggaggaagcaataatagtcacaatatggacaacgggaagtacgtgaggtacactcctgaacaagtggaagctctggagagactctacaatgactgtcctaaaccgagctctatgcgccgccaacagctaatccgcgaatgtcctatcctctccaacatcgagcctaaacagataaaagtctggttccagaaccgcaggtgtagagaaaaacagcgaaaagaggcgtcacgacttcaagctgtgaataggaagctaacggcaatgaacaagcttttgatggaagagaatgaccgcttgcaaaagcaagtgtctcacttggtttatgagaacagctattttcgccaacatcctcaaaaccaggggaatttggctaccacagatactagctgtgagtcagtggtgacgagtggtcaacaccacttgacccctcaacatcagcctcgtgatgctagtcctgctggattattgtccattgcggatgaaactttaacagagttcatttccaaggcgactggaaccgctgtcgagtgggtccaaatgcctgggatgaagcctggtccggattccataggaatcgttgctatttctcatggatgcacgggaatcgctgctcgtgcttgcggccttgtgggtcttgatcccacaagggtcgcggagatcctaaaggataagccttgttggttgcgtgattgcagatctctggatatagttaacgtactatccactgcaaatggtggaacccttgaactaatctacatgcagctttatgcgccgacaacactggcaccagctcgtgacttctggatgctacgttacacatctgtaatggaagacgggagccttgtgatatgcgaacgatcactgaacaatacacaaaacgggccaagtatgcctccgtctcctcatttcgttagggcagagattttaccaagtggttacctcattagaccttgcgaaggaggtggatccattcttcacattgtcgatcatttcgatcttgagccatggagtgtgccagaagttcttcgttctctctatgagtcctccactttactcgcccaaagaactacaatggccgctctgcgctatttgaggcaaatatctcaagagatttcacaacctaacgtaacaggttggggaagaagaccagcggctcttagagcacttagccaaaggcttagcaaaggattcaacgaagcagtgaatgggttcagcgatgaaggatggtccatcctagagagtgatggtatcgatgatgtcactcttcttgtgaactcctctcccacaaagatgatgatgacttcaagtctcccatttgccaatggctacacttctatgcctagcgcggtcttatgtgccaaagcttccatgttattacaaaatgttccaccttcgattctgctgcggttcttgagggaacatagacaagaatgggcagacaatagcatcgatgcatattcggccgcagccatcaaagcaggcccttgtagcttaccaatccctcgcccagggagctttggtggtcaagtcattcttcctctagctcacactatagagaatgaagagtttatggaagtcattaagcttgagagcttggggcactaccaagaagacatgatgatgcctgctgatatcttccttctgcaaatgtgcagtggggtggatgagaacgcagttgaatcatgcgcagagcttatatttgcaccaatcgacgcatctttctctgatgatgcaccaatcattccttccggtttccgcatcattcctctagattccaaatcagaggggttgagtcctaaccgaacgctagacctagcgtcggctctagacgtagggagcagaacagccggagattcatgtggaagcagaggaaactcaaagtccgttatgactatagcgtttcagctagcttttgagatgcatatgcaagagaatgtagcctcaatggctagacagtatgtaagaagtgtgatcgcgtcggttcaacgggtcgcacttgctctctctccttcttctcatcagctaagtggcttgcgtcctccacccgcgtcacccgaagctcacactctcgctcgctggatctctcactcttatagatgttaccttggcgttgatcttctcaaacctcatggaactgatcttctcaagtctctttggcaccatcctgacgctgtcatgtgttgctcactcaaggccttatctccggtattcacatttgcgaaccaagctggtttagacatgctggagacgacgttggtggcacttcaagatatcactctcgacaagatcttcgacaacaacaacgggaagaagactttatcctccgaattccctcagatcatgcaacaggggtttatgtgtatggatggaggaatatgcatgtcgagcatgggaagagcagtaacgtacgagaaggctgttgggtggaaagtgttgaacgacgacgaagatcctcattgtatctgcttcatgttcctcaactggtcttttatatga

SEQ ID NO: 1994 - protein, 833 aa, Arabidopsis thaliana
  G392  Paralogous to G390, G391, G438
MGGGSNNSHNMDNGKYVRYTPEQVEALERLYNDCPKPSSMRRQQLIRECPILSNIEPKQIKVWFQNRRCREKQRKEASRLQAVNRKLTAMNKLLMEENDRLQKQVSHLVYENSYFRQHPQNQGNLATTDTSCESVVTSGQHHLTPQHQPRDASPAGLLSIADETLTEFISKATGTAVEWVQMPGMKPGPDSIGIVAISHGCTGIAARACGLVGLDPTRVAEILKDKPCWLRDCRSLDIVNVLSTANGGTLELIYMQLYAPTTLAPARDFWMLRYTSVMEDGSLVICERSLNNTQNGPSMPPSPHFVRAEILPSGYLIRPCEGGGSILHIVDHFDLEPWSVPEVLRSLYESSTLLAQRTTMAALRYLRQISQEISQPNVTGWGRRPAALRALSQRLSKGFNEAVNGFSDEGWSILESDGIDDVTLLVNSSPTKMMMTSSLPFANGYTSMPSAVLCAKASMLLQNVPPSILLRFLREHRQEWADNSIDAYSAAAIKAGPCSLPIPRPGSFGGQVILPLAHTIENEEFMEVIKLESLGHYQEDMMMPADIFLLQMCSGVDENAVESCAELIFAPIDASFSDDAPIIPSGFRIIPLDSKSEGLSPNRTLDLASALDVGSRTAGDSCGSRGNSKSVMTIAFQLAFEMHMQENVASMARQYVRSVIASVQRVALALSPSSHQLSGLRPPPASPEAHTLARWISHSYRCYLGVDLLKPHGTDLLKSLWHHPDAVMCCSLKALSPVFTFANQAGLDMLETTLVALQDITLDKIFDNNNGKKTLSSEFPQIMQQGFMCMDGGICMSSMGRAVTYEKAVGWKVLNDDEDPHCICFMFLNWSFI

SEQ ID NO: 1995 - DNA, 1535 bp, Arabidopsis thaliana
  G425  Predicted polypeptide sequence is paralogous to G427
gaaaacagtcttctcttctccgatcccaaaaacgcaggaaaacaatgtcgtttaacagctcccacctccttcctccacaagaagaccttcctctccgacacttcaccgatcaatcacagcaacctccgccgcagcgtcacttctctgaaacaccttcgcttgtcaccgccagtttcctcaacctccctaccacccttaccactgcggattccgatctcgctcctccgcaccgcaacggagacaattccgttgctgatacaaacccacgctggctctcctttcattcggagatgcaaaatactggagaagtacgttctgaagttatcgacggagtcaacgccgatggtgaaacgatactcggcgttgtaggaggtgaagattggcggagtgctagctataaggcggcgattttaagacatccgatgtacgagcagcttcttgcggctcacgtggcttgccttagggttgcgactcccgttgaccagattccgaggatcgatgctcagctcagtcagttgcataccgtcgccgcgaaatactccactcttggtgtggttgttgacaacaaggaacttgatcatttcatgtcacattatgttgtcttgttatgttcatttaaagaacaactccaacaccacgtttgtgtccatgcaatggaagccattacggcttgttgggagattgaacaatcactgcaatccctaactggagtttctccaagtgaaagtaatggtaagacaatgtcggatgatgaagatgataatcaagtagagagcgaggtgaacatgtttgatggaagtttggacggttcagattgcttgatggggtttggtcctcttgttccaaccgagagagagagatctttgatggaacgtgtgaagaaagaactgaagcatgagcttaaacagggtttcaaagagaagattgtggacataagagaagagataatgaggaagagaagggcgggaaagttgccaggagatacgacttctgtactcaaagaatggtggcgaactcactcgaaatggccatacccaactgaggaagataaggcaaaactggttcaagaaaccggtttgcagttgaaacagatcaacaattggttcatcaaccagaggaaaagaaactggaacagcaactcttccacgtcatctactctcaccaagaacaaacgtaaacggaccgggaagtcgtaggtgacatagcggctaactagaggatggttctttgccatgtgaattcttgggaaccgtatatgaaagaaacgaatccggttctatgctcgtacagagtgtgttatttgtatagtggataccggttagcctatgaaaccggattctggagtccaaattgttgtttgtaacgacttagtagtttttggaagtgatctgtttcgttggtttgcgtcttgtaacgaacgcttaagcaagtgtgggttttttcttgtaaagtgtcaatatgttcgtttgtaatgaatgtatcaagcaatatttatcataattaaactagcttgaaatgtaaaaaaaaaaaaaaaa

SEQ ID NO: 1996 - protein, 383 aa, Arabidopsis thaliana
  G425  Paralogous to G427
MSFNSSHLLPPQEDLPLRHFTDQSQQPPPQRHFSETPSLVTASFLNLPTTLTTADSDLAPPHRNGDNSVADTNPRWLSFHSEMQNTGEVRSEVIDGVNADGETILGVVGGEDWRSASYKAAILRHPMYEQLLAAHVACLRVATPVDQIPRIDAQLSQLHTVAAKYSTLGVVVDNKELDHFMSHYVVLLCSFKEQLQHHVCVHAMEAITACWEIEQSLQSLTGVSPSESNGKTMSDDEDDNQVESEVNMFDGSLDGSDCLMGFGPLVPTERERSLMERVKKELKHELKQGFKEKIVDIREEIMRKRRAGKLPGDTTSVLKEWWRTHSKWPYPTEEDKAKLVQETGLQLKQINNWFINQRKRNWNSNSSTSSTLTKNKRKRTGKS

SEQ ID NO: 1997 - DNA, 1751 bp, Arabidopsis thaliana
  G426  Predicted polypeptide sequence is paralogous to G427
agagagagaactagtctgtgtcttttttttttttttttggtgataattgaaacatatgaaacaatcgtcgtcatagaagcagcagagattcaccttctttctttatctttccctctcagaaacaggaaacaaaattcaaaaagaacaaaaaaaaaaggtcaaaccaaaaacgatggcgtttcatcacaatcatctctctcaagacctctccttcaatcatttcaccgaccaacaccaacctccacctccgcaaccgcctcctcctcctccgcaacagcaacaacatttccaagaagcaccgcctcctaattggttaaacacagcgcttcttcgttcctcagataacaacaataacttcctcaacctccacacagccaccgctaacaccacaaccgcaagcagctccgattctccttcctccgccgccgccgccgccgctgctaaccagtggctatctcgctcctcctctttcctccaacgaaacaacaacaacaacgcttccatagtcggagatgggatcgatgatgtcaccggaggagcagacactatgattcagggagagatgaaaaccggcggtggagaaaacaaaaacgacggcggaggagctacggcggcggatggagtagtgagctggcagaatgcgagacacaaggcggagatcctttcgcatcctctttacgagcagcttttgtcggcgcacgttgcttgtttgagaatcgcgactccggttgatcagcttccgagaatcgatgctcagcttgctcagtctcaacacgtcgtcgctaaatactcagctttaggcgccgccgctcaaggtctcgtcggcgacgataaagaacttgaccagttcatgacacattatgtgttgctactgtgttcatttaaagagcaattgcaacaacatgtgcgtgttcatgcaatggaagctgtgatggcttgttgggagattgagcagtctcttcaaagcttaacaggagtgtctcctggagaagggatgggagcaacaatgtctgacgatgaagatgaacaagtagagagtgatgctaatatgttcgatgggggattagatgtgttgggttttggtcctttgattcctactgagagtgagaggtcgttgatggaaagagttagacaagaacttaaacatgaactcaaacagggttacaaggagaagatagtagacataagagaggagatattaaggaagagaagagctgggaagttaccaggagataccacctctgttctcaaagcttggtggcaatctcattccaaatggccttaccctactgaggaagataaggcgaggttggtgcaagagacaggtttgcagctaaaacagataaacaattggttcatcaatcagagaaagaggaactggcatagcaatccatcttcttccactgtattgaagaacaaacgcaaaagcaatgcaggtgacaatagcggaagagagcggttcgcgtagaaacaacaaacatatgatgtgaattggggaggtggaagatgggatttgaaagcagggttttagggatttaaagttgagaattttatggaggagtttgggttatacagagagaggggacagtattagaaagtaactttttgtgcaattacatagtaacgtagtttggttatgtgattatgcccatatattttattaagtagcacacaaaccaaaaagaaaatatgaaaactgaagatgcaggcttttgtttaatgttttttgtttgtttgtctgcaaaaaaaaa

SEQ ID NO: 1998 - protein, 431 aa, Arabidopsis thaliana
  G426  Paralogous to G427
MAFHHNHLSQDLSFNHFTDQHQPPPPQPPPPPPQQQQHFQEAPPPNWLNTALLRSSDNNNNFLNLHTATANTTTASSSDSPSSAAAAAAANQWLSRSSSFLQRNNNNNASIVGDGIDDVTGGADTMIQGEMKTGGGENKNDGGGATAADGVVSWQNARHKAEILSHPLYEQLLSAHVACLRIATPVDQLPRIDAQLAQSQHVVAKYSALGAAAQGLVGDDKELDQFMTHYVLLLCSFKEQLQQHVRVHAMEAVMACWEIEQSLQSLTGVSPGEGMGATMSDDEDEQVESDANMFDGGLDVLGFGPLIPTESERSLMERVRQELKHELKQGYKEKIVDIREEILRKRRAGKLPGDTTSVLKAWWQSHSKWPYPTEEDKARLVQETGLQLKQINNWFINQRKRNWHSNPSSSTVLKNKRKSNAGDNSGRERFA

SEQ ID NO: 1999 - DNA, 1507 bp, Arabidopsis thaliana
  G440  Predicted polypeptide sequence is paralogous to G1750
aaaaaatcactgtttcataacacgtttttctctctcacccaccaaaaaaaaatcttttgttcttgttaccaaaaaatctcgtgataaatctcttcaaactttgttttattttcttcttgattctctcgaaatctctctcaacaaacccagaaactttccttgattcgcaagcttttcttccttttatattcttcattttgatgcgaatatagagagagtccataaaagaaacagtaatggacgaatatattgatttccgaccattgaagtacacagagcacaagacttcaatgactaaatacaccaaaaagtcatcggaaaaactttccggtggtaagtcattgaaaaaggttagtatttgttatactgatcctgacgcaacagattcatcaagtgacgaagacgaagaagatttcttgtttcctcgccggagagtcaaaagattcgttaacgagatcactgttgagcctagctgtaacaacgtcgtcaccggagtttcgatgaaagatagaaagagactctcttcttcctccgatgaaactcaatctccggcgtcgagtcgtcaacgtcctaataacaaagtttcagtctccggtcagataaagaagttccgtggtgttagacaacggccatgggggaaatgggcggcggagattagagatccggagcaacgtcggaggatttggctcgggacttttgagacggcggaggaagctgccgtggtttatgataacgccgctataagactccgtggaccggacgctttaactaatttctccataccgcctcaagaagaggaagaagaagaagaaccggaaccggttattgaggagaaaccggttattatgacgacgccaacaccaacaacatcgagttctgaatcaactgaagaagatttacaacatctctcatctcctacttcggttctcaatcaccggtcagaagagattcaacaagtacaacaaccgtttaaatcagctaaacccgaaccgggggtttcaaatgcaccatggtggcataccgggtttaataccggtttaggtgaatcagacgattcatttcctttggatactccgtttcttgacaactatttcaatgaatcaccaccagagatgtcaatatttgaccaaccaatggatcaaattttctgtgaaaatgatgatatcttcaatgatatgttgttcttgggtggtgaaactatgaacattgaagatgagttaacaagttctagtatcaaagatatgggttcaacgtttagtgattttgatgattcattgatatcagatctattagttgcttaatatgatgatgagagtgaagaagaaaccatcaagcaaatatctatggtgtgactgaaaaattttggtgttacttttttttctttcataagttcatgagcttttttgtttcttttttttaataatttatttagttttgtcaggagcttgtaaaacagttttggagaaatagtggaaaaatagtttaattaaaaaaaaaaaaaaaaaaa

SEQ ID NO: 2000 - protein, 354 aa, Arabidopsis thaliana
  G440  Paralogous to G1750
MDEYIDFRPLKYTEHKTSMTKYTKKSSEKLSGGKSLKKVSICYTDPDATDSSSDEDEEDFLFPRRRVKRFVNEITVEPSCNNVVTGVSMKDRKRLSSSSDETQSPASSRQRPNNKVSVSGQIKKFRGVRQRPWGKWAAEIRDPEQRRRIWLGTFETAEEAAVVYDNAAIRLRGPDALTNFSIPPQEEEEEEEPEPVIEEKPVIMTTPTPTTSSSESTEEDLQHLSSPTSVLNHRSEEIQQVQQPFKSAKPEPGVSNAPWWHTGFNTGLGESDDSFPLDTPFLDNYFNESPPEMSIFDQPMDQIFCENDDIFNDMLFLGGETMNIEDELTSSSIKDMGSTFSDFDDSLISDLLVA

SEQ ID NO: 2001 - DNA, 971 bp, Arabidopsis thaliana
  G448  Predicted polypeptide sequence is paralogous to G450
tttccatcttcctcatcaccttcccaagaagaagaacaccaaagaagaagaaaggttaataatgatgggcagtgtcgagctgaatctgagggagactgagctgtgtcttggtcttcccggtggagatacagtggctccggtaaccggaaacaagagagggttctcagagacggttgatctgaagctaaatctgaataatgagcctgcaaacaaggaaggatctacgactcatgacgtcgtgacttttgattccaaggagaagagtgcttgtcctaaagatccagccaaacctccggccaaggcacaagttgtgggatggccaccggtgagatcataccggaagaacgtgatggtttcctgccaaaaatcaagcggtggcccggaggcggcggcgttcgtgaaggtatcaatggacggagcaccgtacttgaggaaaatcgatttgaggatgtataaaagctacgatgagctttctaatgctttgtccaacatgttcagctcttttaccatgggcaaacatggaggagaagaaggaatgatagacttcatgaatgagaggaaattgatggatttggtgaatagctgggactatgttccctcttatgaagacaaagacggtgattggatgctcgtcggcgacgttccttggccaatgttcgtcgatacatgcaagcgtttacgtctcatgaaaggatcggatgccattggtctcgctccgagggcgatggagaagtgcaagagcagagcttgaagtcaaattaaaaggataagtggtatcgattatatatttgattaacacattgattggtgttaattgctctttttttttcttacgatgaaatacattgttcagtttcttttgattgtctgtgttttgatctggatttggtatgtagatatagtttgtatgctattatgtgtaatgaacttaagttaaatatttgagacatttgtaatggaaaatgtgtaat

SEQ ID NO: 2002 - protein, 229 aa, Arabidopsis thaliana
  G448  Paralogous to G450
MMGSVELNLRETELCLGLPGGDTVAPVTGNKRGFSETVDLKLNLNNEPANKEGSTTHDVVTFDSKEKSACPKDPAKPPAKAQVVGWPPVRSYRKNVMVSCQKSSGGPEAAAFVKVSMDGAPYLRKIDLRMYKSYDELSNALSNMFSSFTMGKHGGEEGMIDFMNERKLMDLVNSWDYVPSYEDKDGDWMLVGDVPWPMFVDTCKRLRLMKGSDAIGLAPRAMEKCKSRA

SEQ ID NO: 2003 - DNA, 899 bp, Arabidopsis thaliana
  G455  Predicted polypeptide sequence is paralogous to G450
tttctaatctattacaagtaacatgatcggccaacttatgaacctcaaggccacggagctctgtctcggcctccccggcggcgctgaagcagttgagagtcctgccaaatcggcggtgggaagcaagagaggcttctccgaaaccgttgatctcatgctcaatcttcaatctaacaaagaaggctccgttgatctcaaaaacgtttctgctgttcccaaggagaagactacccttaaagatccttctaagcctcctgctaaagcacaagtggtgggatggccacctgtgaggaactacaggaagaacatgatgactcagcagaagaccagtagtggtgcggaggaggccagcagtgagaaggccgggaactttggtggaggagcagccggagccggcttggtgaaggtctccatggacggtgctccatatctgaggaaagttgacctcaagatgtacaaaagctaccaggatctttctgatgcattggccaaaatgttcagctcctttactatgggaaactatggagcacaaggaatgatagatttcatgaacgagagcaagctaatgaatctgctgaatagctctgagtatgtgccaagctacgaggacaaagatggtgactggatgctcgttggcgatgtcccatgggaaatgtttgtcgagtcttgcaaacgtttgcgcattatgaagggatctgaagcagttggacttgctccgagagcaatggagaagtactgcaagaacagatcttgaattaataataaaaaaaaagaagcatcaatgatcaacaatatgacgggttcttgattttatatgtatttttatgattgtatgtggctatcacctatatatgtgtgttgtaattttaaatacttgatgggtatatagggcagtattt

SEQ ID NO: 2004 - protein, 243 aa, Arabidopsis thaliana
  G455  Paralogous to G450
MIGQLMNLKATELCLGLPGGAEAVESPAKSAVGSKRGFSETVDLMLNLQSNKEGSVDLKNVSAVPKEKTTLKDPSKPPAKAQVVGWPPVRNYRKNMMTQQKTSSGAEEASSEKAGNFGGGAAGAGLVKVSMDGAPYLRKVDLKMYKSYQDLSDALAKMFSSFTMGNYGAQGMIDFMNESKLMNLLNSSEYVPSYEDKDGDWMLVGDVPWEMFVESCKRLRIMKGSEAVGLAPRAMEKYCKNRS

SEQ ID NO: 2005 - DNA, 1169 bp, Arabidopsis thaliana
  G456  Predicted polypeptide sequence is paralogous to G450
cacacatctcacatccccctatctctctctctcttcaaacgttttagttccccaaaaaaatatcaaaagaactaaaagaaaaaccctagaagccgaagaatctcctactcgttgtcgatcggatcacctaactaattactcgttgataatcattatatcgagaaatatgattaattttgaggccacggagctgagattagggctaccgggtgggaatcacggaggagaaatggctggaaaaaataatggtaaaagaggattttctgagactgttgatctcaaactgaatctttcatcgacggctatggattcagtttccaaagtcgatttagagaatatgaaggagaaggtcgtaaaaccaccagccaaggcacaagttgtgggatggccaccggtacgatctttccgcaagaacgtcatgtccggccaaaaaccgaccaccggagatgccaccgaaggaaacgataagacttctggcagcagtggagccacctcatccgcctccgcatgtgccaccgtggcttatgtgaaggttagcatggacggtgcaccgtacctacggaaaattgacttgaaactctacaaaacttaccaagatctctccaacgccttaagcaaaatgtttagctcttttaccataggcaactatggaccacaaggaatgaaagatttcatgaatgagagtaaattgatcgatcttctaaacggatcagattatgttccaacatatgaagataaagatggcgactggatgcttgtaggagacgtaccgtgggagatgtttgttgattcatgcaaacgtatacgaataatgaagggatcagaagcaatcggacttgctccaagggcattagaaaagtgcaagaacagaagttgagttctcgacgacatttcgtgttcttacctaaaaaaggaagaaagcctgtttcgatcggttggatatctcgaaccgagaaagctaaaccggctcgaaactattgttccgagcaaggagtttgcttataatattaattaataataatattaatattgtggtgtattacattttaaaaaattaaatcgtttttgttatatgtattatatacatatattaatatgtatatttaattaggttgcatctatttccgttaaaaccaacttttgtttttacgcaaaaaaaaagagttcac

SEQ ID NO: 2006 - protein, 236 aa, Arabidopsis thaliana
  G456  Paralogous to G450
MINFEATELRLGLPGGNHGGEMAGKNNGKRGFSETVDLKLNLSSTAMDSVSKVDLENMKEKVVKPPAKAQVVGWPPVRSFRKNVMSGQKPTTGDATEGNDKTSGSSGATSSASACATVAYVKVSMDGAPYLRKIDLKLYKTYQDLSNALSKMFSSFTIGNYGPQGMKDFMNESKLIDLLNGSDYVPTYEDKDGDWMLVGDVPWEMFVDSCKRIRIMKGSEAIGLAPRALEKCKNRS

SEQ ID NO: 2007 - DNA, 1262 bp, Arabidopsis thaliana
  G463  Predicted polypeptide sequence is paralogous to G464
ctcgagctacgtcaggggtctctttctgtttgtttgttttcttgtttccttctctctctctctttctttctttgtcttcctttcccaggttgtttttttttgctctctctgccttcttgactttcaaaagactctttctttcttttggattgattttggattctagggctctctttcttttagtgggtttttgttgttgttgttgtggtctctctgatgattactgaacttgagatggggaaaggtgagagtgagcttgagcttggtctagggctgagtcttggcggtggaacggcggccaagattggtaaatcaggtggtggtggcgcgtggggagagcgtggaaggcttttgacggctaaggattttccttctgttggttctaaacgtgctgctgattctgcttctcatgctggttcatctcctcctcgttcaagtcaagttgttggatggcctcctatagggtcacacaggatgaacagtttggttaataaccaagctacaaagtcagcaagagaagaagaagaagctggtaagaagaaagtgaaagatgatgaacctaaagatgtgacaaagaaagtgaatgggaaagtacaagttggatttattaaggtgaacatggatggagttgctataggaagaaaagtggatttgaatgctcattcttcttacgagaatttggcgcaaacattggaagatatgttctttcgcactaatccgggtactgtcgggttaaccagtcagttcactaaaccgttgaggcttttagatggatcgtctgagtttgtacttacttatgaagataaggaaggagattggatgcttgttggtgatgttccatggagaatgttcatcaactcggtgaaaaggctacgtgtgatgaaaacctctgaagctaatggactcgctgcacgaaatcaagaaccaaacgagagacagcgaaagcagccggtttagatctcttttcgacgttacggtgttacaggttttatattttggggttttgcaagtctgagatacttctgaagcaagcataagctagattgatcttatatccagtttgtgtattttcttggttcttataatggtttttactggttttctttagtttttttttttgctgtcttttaattttcggttgcgatttcactatatactatggatggaagagaatgctctttatatcttttactacactgtaaatatttgaagcttatctaatatcgtttttaagggttaaaaaaccctgacgtagcctcgag

SEQ ID NO: 2008 - protein, 246 aa, Arabidopsis thaliana
  G463  Paralogous to G464
MITELEMGKGESELELGLGLSLGGGTAAKIGKSGGGGAWGERGRLLTAKDFPSVGSKRAADSASHAGSSPPRSSQVVGWPPIGSHRMNSLVNNQATKSAREEEEAGKKKVKDDEPKDVTKKVNGKVQVGFIKVNMDGVAIGRKVDLNAHSSYENLAQTLEDMFFRTNPGTVGLTSQFTKPLRLLDGSSEFVLTYEDKEGDWMLVGDVPWRMFINSVKRLRVMKTSEANGLAARNQEPNERQRKQPV

SEQ ID NO: 2009 - DNA, 486 bp, Arabidopsis thaliana
  G485  Predicted polypeptide sequence is paralogous to G481, G482
atggcggattcggacaacgattcaggaggacacaaagacggtggaaatgcttcgacacgtgagcaagataggtttctaccgatcgctaacgttagcaggatcatgaagaaagcacttcctgcgaacgcaaaaatctctaaggatgctaaagaaacggttcaagagtgtgtatcggaattcataagtttcatcaccggtgaggcttctgacaagtgtcagagagagaagaggaagacaatcaacggtgacgatcttctttgggcgatgactacgctagggtttgaggactacgtggagcctctcaaggtttatctgcaaaagtatagggaggtggaaggagagaagactactacggcagggagacaaggcgataaggaaggtggaggaggaggcggtggagctggaagtggaagtggaggagctccgatgtacggtggtggcatggtgactacgatgggacatcaattttcccatcatttttcttaa

SEQ ID NO: 2010 - protein, 161 aa, Arabidopsis thaliana
  G485  Paralogous to G481, G482
MADSDNDSGGHKDGGNASTREQDRFLPIANVSRIMKKALPANAKISKDAKETVQECVSEFISFITGEASDKCQREKRKTINGDDLLWAMTTLGFEDYVEPLKVYLQKYREVEGEKTTTAGRQGDKEGGGGGGGAGSGSGGAPMYGGGMVTTMGHQFSHHFS

SEQ ID NO: 2011 - DNA, 1346 bp, Arabidopsis thaliana
  G501  Predicted polypeptide sequence is paralogous to G519
cttacgggtccctatccttcgcaagacccttcctctatataaggaagttcttttcatttggagaggtcacgctgacaagctgactctagcagatctggtaccgtcgacccacgcgtccgaaaaaatccagatccagctgaaattgaattttcaaccaacgaagaagagatttttccaagagcaacagacaagaagaagagaatgaagtcggagctaaatttaccagctgggttccgattccatccaacggacgaggagcttgtgaaattctacttgtgccggaaatgtgcttccgagcagatctcggctccggttatcgccgagattgatctctacaagttcaatccttgggagcttccagagatgtctctgtacggagagaaagagtggtacttcttctcacctagagatcggaaatacccaaacggttcgcgtcctaaccgggcagcaggaaccggttattggaaagctaccggagcagataaaccgattggtaaaccgaagacgttgggtatcaagaaagcactcgtcttctacgcagggaaagctccaaaagggattaagaccaattggataatgcatgagtatcgtctcgctaatgttgatagatcagcttctgttaacaaaaagaacaacctacgacttgatgattgggttttatgtcgaatatacaacaagaaaggaaccatggagaagtatttccccgcggatgagaagccgaggaccacgacaatggctgaacagtcatcatcaccttttgatacatcagactcgacttacccgacattgcaagaggatgattccagcagctcaggtggtcacggtcacgtggtgtcaccggatgttttggaggttcagagcgagcctaaatggggagagcttgaggatgctttggaagcttttgatacttcaatgtttggtagttccatggagttgttgcagcctgacgcttttgtccctcagttcttgtatcagtctgattatttcacttccttccaggatccgcctgagcagaaaccattcttgaattggagttttgctccacaggggtaaaaacggaagagaccaaaaaaggtgtttgctagtagtactgtgatgtgccagagagaagagtctcatctcaactcatccctggctcttagtagtaaaagaagattgtagaatgttaatagcttttagcatcaatgtctcattagcaggcacattcttgttctttcatgagaagtttatatgaaaactaaaaatttatattcaaattcttcaagatgttgcacttatgtagatactgatattaaataacaacctaacctttatgagaaaaaaaaaaaaaaaaaaaaaaaaaaaaa

SEQ ID NO: 2012 - protein, 283 aa, Arabidopsis thaliana
  G501  Paralogous to G519
MKSELNLPAGFRFHPTDEELVKFYLCRKCASEQISAPVIAEIDLYKFNPWELPEMSLYGEKEWYFFSPRDRKYPNGSRPNRAAGTGYWKATGADKPIGKPKTLGIKKALVFYAGKAPKGIKTNWIMHEYRLANVDRSASVNKKNNLRLDDWVLCRIYNKKGTMEKYFPADEKPRTTTMAEQSSSPFDTSDSTYPTLQEDDSSSSGGHGHVVSPDVLEVQSEPKWGELEDALEAFDTSMFGSSMELLQPDAFVPQFLYQSDYFTSFQDPPEQKPFLNWSFAPQG

SEQ ID NO: 2013 - DNA, 1409 bp, Arabidopsis thaliana
  G502  Predicted polypeptide sequence is paralogous to G519
ttgatgccgctcaatcccactatccttcgcaaggacccttcctctatataaggaagttcatttcatttggagaggacacgctgacaagctgactctagcagatctgggaccgtcgacccacgcgtccgaattgattaggataggatcaggatcatcctcaacaacctcctcctaattcctcctccattcatagtaacaataatattaagaaagagggtaaactatgtcagaattattacagttgcctccaggtttccgatttcaccctaccgatgaagagcttgtcatgcactatctctgccgcaaatgtgcctctcagtccatcgccgttccgatcatcgctgagatcgatctctacaaatacgatccatgggagcttcctggtttagccttgtatggtgagaaggaatggtacttcttctctcccagggacagaaaatatcccaacggttcgcgtcctaaccggtccgctggttctggttactggaaagctaccggagctgataaaccgatcggactacctaaaccggtcggaattaagaaagctcttgttttctacgccggcaaagctccaaagggagagaaaaccaattggatcatgcacgagtaccgtctcgccgacgttgaccggtccgttcgcaagaagaagaatagtctcaggctggatgattgggttctctgccggatttacaacaaaaaaggagctaccgagaggcggggaccaccgcctccggttgtttacggcgacgaaatcatggaggagaagccgaaggtgacggagatggttatgcctccgccgccgcaacagacaagtgagttcgcgtatttcgacacgtcggattcggtgccgaagctgcatactacggattcgagttgctcggagcaggtggtgtcgccggagttcacgagcgaggttcagagcgagcccaagtggaaagattggtcggccgtaagtaatgacaataacaatacccttgattttgggtttaattacattgatgccaccgtggataacgcgtttggaggaggagggagtagtaatcagatgtttccgctacaggatatgttcatgtacatgcagaagccttactagaagggaattcctttcctgccgccgaaacgcaacgcaaaacgaccctcgtttttgcgtttatggcaacacgagaccgttttatatggtcaatgagtgtgccgattcggccattagatttctgttcagtcttcgtttattctatagaccgtccgatttcagatcatccctaatcggacggtggtcgttggatgtatcagtagtgtattactgtgttaggtagaagaaaatccacttgttcttaaattggcataaaagtcagaagctaatatttatatgtgccgcaatcaatttaatattttctgtctaaaaaaaaaaa

SEQ ID NO: 2014 - protein, 289 aa, Arabidopsis thaliana
  G502  Paralogous to G519
MSELLQLPPGFRFHPTDEELVMHYLCRKCASQSIAVPIIAEIDLYKYDPWELPGLALYGEKEWYFFSPRDRKYPNGSRPNRSAGSGYWKATGADKPIGLPKPVGIKKALVFYAGKAPKGEKTNWIMHEYRLADVDRSVRKKKNSLRLDDWVLCRIYNKKGATERRGPPPPVVYGDEIMEEKPKVTEMVMPPPPQQTSEFAYFDTSDSVPKLHTTDSSCSEQVVSPEFTSEVQSEPKWKDWSAVSNDNNNTLDFGFNYIDATVDNAFGGGGSSNQMFPLQDMFMYMQKPY

SEQ ID NO: 2015 - DNA, 1285 bp, Arabidopsis thaliana
  G512  Predicted polypeptide sequence is paralogous to G1452
aaagctccctgagcaagtgagaagagaccacactgagaagaaaaatccttcaggttatcgaaaattcccggattttactctttgggcggtggccgatttcttacgcgctctttttgtggcgactgttgtatacgcgcgagccttcatggacacgaaggcggttggagtttctaaggatacggcggcgtcgatggaagcgtcgacggtgtttcctgggtttaaattctcgccgacggatgtggagttgatttcgtattacctgaagcggaagatggatggcttggagaggtccgttgaggttataccggaccttgagatttacaatttcgagccttgggatttacccgataagtcgattgtgaaatctgatagcgagtggttcttcttctgtgcgcgtgggaaaaagtatccacatggttcacagaacaggagagcaacgaagatgggatactggaaagcaactgggaaagagcgtgatgtgaagtctggttctgaggtcattggaacaaagaggacgcttgttttccatattggtcgtgcaccaaaaggcgaaagaactgactggattatgcacgagtactgcgtgaaaggagtatctctggatgatgctatggttgtttgccgggttaggaggaacaaagaatacaatagtggtacaagtcagaaggcaccaaagccaaattcatcagccgagaagcatgcgaaagtccaaaatggcgctacgagttcagggagcccgtctgattgggacaacttggttgatttttacctagcaggtgaatcaggggagaaactactcgctgagatggcagagtcatcagaaaatctacaggtggataatgacgaggatttctttgcggatatcctaagagacgaaatcatcaatctcgatgaagcggtgatgacagggaacacaccaaacgaagtgccaacactagaatcagcatcaatggagataagggtacttcctttaccaaacatgatagacaaacaaatgtcatcactgttagaggaaagaccatcacagaagaagaaaggaaaagacgccacggaatcattgtcgagctgcttcgtgggtttatactcgatcaaatcagtgaacaaggcacgatgggatgttattataggtgtagtggctctgatagcaatgttgttttatctagaataagaggcttatggaagtagcgaaaaacagtgtcctagctatgtttgtatcatcttttctcggacattgacaaggattatatgatgtttttgtgtaaaaaaaaaaaaaaaaaaaaaaaaa

SEQ ID NO: 2016 - protein, 340 aa, Arabidopsis thaliana
  G512  Paralogous to G1452
MDTKAVGVSKDTAASMEASTVFPGFKFSPTDVELISYYLKRKMDGLERSVEVIPDLEIYNFEPWDLPDKSIVKSDSEWFFFCARGKKYPHGSQNRRATKMGYWKATGKERDVKSGSEVIGTKRTLVFHIGRAPKGERTDWIMHEYCVKGVSLDDAMVVCRVRRNKEYNSGTSQKAPKPNSSAEKHAKVQNGATSSGSPSDWDNLVDFYLAGESGEKLLAEMAESSENLQVDNDEDFFADILRDEIINLDEAVMTGNTPNEVPTLESASMEIRVLPLPNMIDKQMSSLLEERPSQKKKGKDATESLSSCFVGLYSIKSVNKARWDVIIGVVALIAMLFYLE

SEQ ID NO: 2017 - DNA, 1339 bp, Arabidopsis thaliana
  G515  Predicted polypeptide sequence is paralogous to G2053
gtcgacaagaagggccgcataaatacaaaaccctatacgtctttcttctccatcattttaagttgcagaagaacatcaaccatggcgaaagctctccaatgcatatttttttgatcttttccttttcccttcttttttgatcgctgcagagaaatggaaactcctgtgggtttaagattctgtccgaccgacgaggagatcgtcgtcgattacctttggccgaaaaattccgatagagacacgagccatgtcgatcgattcattaacacagtccctgtctgtagactcgatccttgggagttaccttgccagtcaaggatcaaactgaaagatgtggcttggtgtttcttcagacctaaggagaacaaatatggcagaggtgatcagcagatgagaaaaacgaaatctgggttttggaagagtactggcagaccaaagcctatcatgcgtaatcgccaacagatcggtgagaaaaagattttgatgttttacacgagtaaggaatccaaatccgattgggttatacacgagtaccacggtttctctcataaccagatgatgatgacatacacactctgtaaagttatgtttaatggtggcatgagagagaagtcttcctcttctccttcttcttctggtgttagtggaattgagcagagtcgtcgtgactctttaatccctcagcttgtcaacaattctgagggatcctcacttcacagagaagatccaagtcagtttggtgatgtgctgcaagaagctccaatcgaggatgctaaactgaccgaggaattggtaaaatggctgatgaatgatgaggatgatgctcaaatcgaggatgctataccgattgaggaatgggaaacatggttgaatgatattgatgatgctaaggagaagagtatcatgtttatgcatgataatcgaagtgattacagacctccaaactcattaactggtgtcttcagtgatgatgttagcagtgatgataatgattctgatttgctaactccaaaaacaaactctattcaaacttcgagcacttgtgatagttttggtagctcaaatcatcgcatagaccagatcaaagacctgcaagaatctcctacctcaacaatcaacttagtgtcactaactcaagaggtgagcgcggccgctaataaccagtattgataccgccgagaagaagaagaatccttatgatgatgcacaagggactgagattggtgagcataaattgggtcaagagacgatcaagaagaaaagagctggtttctttcacaggatgatacaaaaattcgtcaagaaaattcacctatgttcttccatctcaagaacttga

SEQ ID NO: 2018 - protein, 338 aa, Arabidopsis thaliana
  G515  Paralogous to G2053
METPVGLRFCPTDEEIVVDYLWPKNSDRDTSHVDRFINTVPVCRLDPWELPCQSRIKLKDVAWCFFRPKENKYGRGDQQMRKTKSGFWKSTGRPKPIMRNRQQIGEKKILMFYTSKESKSDWVIHEYHGFSHNQMMMTYTLCKVMFNGGMREKSSSSPSSSGVSGIEQSRRDSLIPQLVNNSEGSSLHREDPSQFGDVLQEAPIEDAKLTEELVKWLMNDEDDAQIEDAIPIEEWETWLNDIDDAKEKSIMFMHDNRSDYRPPNSLTGVFSDDVSSDDNDSDLLTPKTNSIQTSSTCDSFGSSNHRIDQIKDLQESPTSTINLVSLTQEVSAAANNQY

SEQ ID NO: 2019 - DNA, 762 bp, Arabidopsis thaliana
  G516  Predicted polypeptide sequence is paralogous to G2053
atgtcgatgaagtcattagcacagttgatatttgtagcttcgacccttgggacttaccttgtaagtctttctaacgcgagtgtttgtttttctttggttcccaactgttgtatcatcccggtaatttctgatcatgttctgtctttcccagcccattctaggatgaaaacaagagatcaggtttggtatttcttcggccgtaaggagaacaaatatggtaaaggtgatcgacagataagaaaaaccaagtctggtttttggaagaaaactggcgttaccatggatataatgcgcaaaacgggagatcgtgagaagatcgttaagtttaagggtgaaaggagagaattttcagttgctactggtagtggaattaagcatactcactctttaatccctcctaccaacaattctggagttttgagtgtagagacagagggatcgttgtttcacagccaagaatcacagaatccaagtcagttttctggctttcttgatgtggatgcactagatagggacttctgcaatattttgagtgatgatttcaaaggcttctttaatgatgacgatgagcagagtaagattgtttctatgcaagatgatcgcaacaaccacacacctcaaaagccattgaccggtgtcttcagtgatcatagcaccgatggtagtgattctgatccgatttctgcaacaactgtaagcaaaattttcctattttacctttactatctcctctgttttcagttttttctcacaaagctatag

SEQ ID NO: 2020 - protein, 253 aa, Arabidopsis thaliana
  G516  Paralogous to G2053
MSMKSLAQLIFVASTLGTYLVSLSNASVCFSLVPNCCIIPVISDHVLSFPAHSRMKTRDQVWYFFGRKENKYGKGDRQIRKTKSGFWKKTGVTMDIMRKTGDREKIVKFKGERREFSVATGSGIKHTHSLIPPTNNSGVLSVETEGSLFHSQESQNPSQFSGFLDVDALDRDFCNILSDDFKGFFNDDDEQSKIVSMQDDRNNHTPQKPLTGVFSDHSTDGSDSDPISATTVSKIFLFYLYYLLCFQFFLTKL

SEQ ID NO: 2021 - DNA, 1080 bp, Arabidopsis thaliana
  G517  Predicted polypeptide sequence is paralogous to G2053
atgatgaatccggtgggtttcagattccgtccaaacgacgaggagatcgtcgaccattacctccggccaaaaaatctcgatagtgacactagccatgtcgatgaagtcattagcacagtcgatatctgtagcttcgagccttgggatttaccttccaagtcgatgatcaaatcgagagatggggtttggtatttctttagtgttaaggagatgaagtataacagaggtgatcaacagagaagaagaacaaactctgggttttggaagaaaactggaaaaacaatgactgtcatgcgcaaaagaggaaatcgtgagaagatcggtgagaaaagggttttggtttttaagaatcgagatggttcaaagaccgactgggttatgcacgagtatcacgctacgtccttgtttcctaatcagatgatgacgtatacagtctgcaaagttgagtttaagggtgaagagacagagatctcttcttcttctactggtagtgaaattgaacagattcactctttaatccctcttgtgaacagttctggaggatctgagggttcgtcgtttcacagccaagaattacagaattcaagtcagtctggtgtctttgctaatgtgcagggagaatctcaaatcgatgatgcaactacaccgattgaggaggaatggaaaacatggttgaataatgatggtgatgagcagaggaatatcatgtttatgcaagatcatcgcagcgattacacacctctaaagtcgttaactggtgtcttcagtgatgatagcagtgatgataatgattctgatttgatatctcctaaaacaaattctattggaacttcgagcacttgtgctagttttgctagctcaaatcatcagatagaccaaactcaacattctcctgactcaacagtccagctagtgtcattaactcaagaggtgagccaaggtccgggtcaagtgactgtgattcgagagcataaattgggtgaagagtctgtcaagaagaaaagagctagtttcgtttacaggatgatacacagattagtcaagaaaattcaccaatgttattctatctcaagaacatga

SEQ ID NO: 2022 - protein, 359 aa, Arabidopsis thaliana
  G517  Paralogous to G2053
MMNPVGFRFRPNDEEIVDHYLRPKNLDSDTSHVDEVISTVDICSFEPWDLPSKSMIKSRDGVWYFFSVKEMKYNRGDQQRRRTNSGFWKKTGKTMTVMRKRGNREKIGEKRVLVFKNRDGSKTDWVMHEYHATSLFPNQMMTYTVCKVEFKGEETEISSSSTGSEIEQIHSLIPLVNSSGGSEGSSFHSQELQNSSQSGVFANVQGESQIDDATTPIEEEWKTWLNNDGDEQRNIMFMQDHRSDYTPLKSLTGVFSDDSSDDNDSDLISPKTNSIGTSSTCASFASSNHQIDQTQHSPDSTVQLVSLTQEVSQGPGQVTVIREHKLGEESVKKKRASFVYRMIHRLVKKIHQCYSISRT

SEQ ID NO: 2023 - DNA, 1832 bp, Arabidopsis thaliana
  G554  Predicted polypeptide sequence is paralogous to G1198
ccttccaaacactattggggaaatggcttcttctcttttttccggtgtaggtttaaggttttagatttgaaggcggatggtgaggagtttgtgttgatgaaatgggtgatttgaagttaaatacctttaagttcttttagccttaagttcttttagcctgtcattacaatatatgtttcagttgtgatcttttggtgctctccaaggtcttagggaatctccgtgtcccctctggtttctttctttgtataaagtctctggaatttaaagatgattttgtcctgttttcttcgaagaatttggcgaagaaacatcaaaagttcactatttgctttacgtgttatgcttgtttgactttgtgtgatctaacttttggttgaaaactaatgctcatcttttgttctttggaatgtcttgatctgcttgattttgaatgctttgtcacattgtttaaacaatttgttctttgttttcagttgaggaaaacatgaattcgacatcgacacattttgtgccaccgagaagagttggtatatacgaacctgtccatcaattcggtatgtggggggagagtttcaaaagcaatattagcaatgggactatgaacacaccaaaccacataataataccgaataatcagaaactagacaacaacgtgtcagaggatacttcccatggaacagcaggaactcctcacatgttcgatcaagaagcttcaacgtctagacatcccgataagatacaaagacggcttgctcaaaaccgcgaggctgctaggaaaagtcgcttgcgcaagaaggcttatgttcagcaactggaaacaagcaggttgaagctaattcaattagagcaagaactcgatcgtgctagacaacagggattctatgtaggaaacggaatagatactaattctctcggtttttcggaaaccatgaatccagggattgctgcatttgaaatggaatatggacattgggttgaagaacagaacagacagatatgtgaactaagaacagttttacacggacacattaacgatatcgagcttcgttcgctagtcgaaaacgccatgaaacattactttgagcttttccggatgaaatcgtctgctgccaaagccgatgtcttcttcgtcatgtcagggatgtggagaacttcagcagaacgattcttcttatggattggcggatttcgaccctccgatcttctcaaggttcttttgccacattttgatgtcttgacggatcaacaacttctagatgtatgcaatctaaaacaatcgtgtcagcaagcagaagacgcgttgactcaaggtatggagaagctgcaacacaccttgcggaccgttgcagcgggacaactcggtgaaggaagttacattcctcaggtgaattctgctatggatagattagaagctttggtcagtttcgtaaatcaggctgatcacttgagacatgaaacattgcaacaaatgtatcggatattgacaacgcgacaagcggctcgaggattattagctcttggtgagtattttcaacggcttagagccttgagctcaagttgggcaactcgacatcgtgaaccaacgtaggtttgagttattttgtaacaaccaaatgaagaaaatggaaagacctcaaaaatgaagaatgagtgcatctgaaaacagaggactactctgaataaatagaggggttgctgctgatatttatttttactctgcggcggaattagaaaatttgaaaaacatcatgtattgataagttgtaaatatcagaaaaaggtgggggtgcaaaaatttgtactttttagcttttgaaagaggcaagttt

SEQ ID NO: 2024 - protein, 367 aa, Arabidopsis thaliana
  G554  Paralogous to G1198
MNSTSTHFVPPRRVGIYEPVHQFGMWGESFKSNISNGTMNTPNHIIIPNNQKLDNNVSEDTSHGTAGTPHMFDQEASTSRHPDKIQRRLAQNREAARKSRLRKKAYVQQLETSRLKLIQLEQELDRARQQGFYVGNGIDTNSLGFSETMNPGIAAFEMEYGHWVEEQNRQICELRTVLHGHINDIELRSLVENAMKHYFELFRMKSSAAKADVFFVMSGMWRTSAERFFLWIGGFRPSDLLKVLLPHFDVLTDQQLLDVCNLKQSCQQAEDALTQGMEKLQHTLRTVAAGQLGEGSYIPQVNSAMDRLEALVSFVNQADHLRHETLQQMYRILTTRQAARGLLALGEYFQRLRALSSSWATRHREPT

SEQ ID NO: 2025 - DNA, 1360 bp, Arabidopsis thaliana
  G555  Predicted polypeptide sequence is paralogous to G1198
caaaagtagtaacctttgttggtgattgatactatatctgttgtgggttttagacaaagaccacgtctttgcagttgtagattggaattttccggatctttctctaaatcgctttttctccgagcaacttttgtttggggttaagctcaaagaatccgttcttttcagtctttactccatctagggtaccacgattggatcggtttttatctgatgatttagtaacagagattttgaagaaaaagaaaaatgggagatactagtccaagaacatcagtctcaacagatggagacactgatcataataacctaatgttcgatgaagggcatttgggtatcggtgcttctgattctagtgaccgttcaaagagtaaaatggatcaaaagacgcttcgtaggctcgctcaaaaccgtgaggctgcaaggaaaagcagattgaggaagaaagcatatgttcagcagctagagaacagtcgattgaagctaacacaacttgagcaggagctacaaagagcacggcaacagggtgtctttatctcaagctctggagaccaagcccattctaccgctggagatggggcaatggcatttgatgtagaatacagacgatggcaggaagataaaaacagacagatgaaggagctgagttctgctatagattctcacgcgactgattctgagcttcggataattgtagatggagtaatagctcactatgaggagctttacaggataaaaggcaacgcagctaagagtgatgtcttccatttattatcagggatgtggaaaaccccagctgagagatgtttcttgtggctcggcggtttccgttcatcagaacttctcaagcttatagcgtgtcagttggagcccttgacagaacaacaatcgctagacataaataacttgcaacagtcaactcagcaagcagaagatgctttgtctcaagggatggacaacttacagcaatcactcgctgatactttatcgagtgggactctcggttcaagttcatcagggaatgtagctagctacatgggtcagatggccatggcgatggggaagttaggtacccttgaaggatttatccgccaggctgataacttaaggctacaaacatatcaacagatggtgagactattaacaacccgacaatcggctcgtgctctccttgcagtacacaattatacattgcggttacgtgctcttagctctctatggcttgccagaccaagagagtgaaccatgactctattatacttcaacgaaggtccagaaaatttgagattcttagcataagatttgacgactttagacacgtagctcgtatacaagattatgattatactgttttgtgttg

SEQ ID NO: 2026 - protein, 330 aa, Arabidopsis thaliana
  G555  Paralogous to G1198
MGDTSPRTSVSTDGDTDHNNLMFDEGHLGIGASDSSDRSKSKMDQKTLRRLAQNREAARKSRLRKKAYVQQLENSRLKLTQLEQELQRARQQGVFISSSGDQAHSTAGDGAMAFDVEYRRWQEDKNRQMKELSSAIDSHATDSELRIIVDGVIAHYEELYRIKGNAAKSDVFHLLSGMWKTPAERCFLWLGGFRSSELLKLIACQLEPLTEQQSLDINNLQQSTQQAEDALSQGMDNLQQSLADTLSSGTLGSSSSGNVASYMGQMAMAMGKLGTLEGFIRQADNLRLQTYQQMVRLLTTRQSARALLAVHNYTLRLRALSSLWLARPRE

SEQ ID NO: 2027 - DNA, 1457 bp, Arabidopsis thaliana
  G556  Predicted polypeptide sequence is paralogous to G1198
cttttttgaagcccttttgacacaaaagaccagaacaagttgaagaaatatgaatacaacctcgacacattttgttccaccgagaaggtttgaagtttacgagcctctcaaccaaatcggtatgtgggaagaaagtttcaagaacaatggagacatgtatacgcctggctctatcataatcccgactaacgaaaaaccagacagcttgtcagaggatacttctcatgggacagaaggaactcctcacaagtttgaccaagaggcttccacatctagacatcctgataagatacagagaaggctagcacagaatcgagaggcagctaggaaaagtcgtttgcgcaagaaagcttatgttcagcagctagagactagccggttaaagctaattcatttagagcaagaactcgatcgtgctagacaacagggtttctatgtggggaacggagtagataccaatgctcttagtttctcagataacatgagctcagggattgttgcatttgagatggaatatggacattgggtggaagaacagaacaggcaaatatgtgaactaagaacggttttacatggacaagttagtgatatagagcttcgttctctagtcgagaatgccatgaaacattactttcaactcttccgaatgaagtcagccgctgcaaaaatcgatgttttctatgtcatgtccggaatgtggaaaacttcagcagagcggtttttcttgtggataggcggatttagaccctcagagcttctcaaggttctgttaccgcattttgatcctttgacggatcaacaacttttggatgtatgtaatctgaggcaatcatgtcaacaatcagaagatgcgttatcccaaggtatggagaaactgcaacatacattagcagagagtgtagcagccgggaaacttggtgaaggaagttatattcctcaaatgacttgtgctatggagagattggaggctttggtcagctttgtaaatcaagctgatcatctgagacatgagacattgcaacagatgcatcggatcttaaccacgcgacaagcggctagaggtttgttagcattaggggagtatttccaaaggcttcgagctttgagttcgagttgggcggctaggcaacgtgaaccaacgtaattaaggtgtttagatgtcaagaaaggtttgagaccttaacaatcaagaatggagtttgctggtgagtggatttttgggtcaagaacaagagcaataacacaagctgctgtgtgatgatgaatcttgtcttgcggctaaaggaaatgtttgaggaaagttgtacatatgatcagcaacgtaaagtttatagctttttagaaaccaacttttcgatggttgttcttttttttttgtatgtaatattatagataagcttgtggtatatatgattttaatgtgacattacgaacttgatttataaccatggtaaaat

SEQ ID NO: 2028 - protein, 364 aa, Arabidopsis thaliana
  G556  Paralogous to G1198
MNTTSTHFVPPRRFEVYEPLNQIGMWEESFKNNGDMYTPGSIIIPTNEKPDSLSEDTSHGTEGTPHKFDQEASTSRHPDKIQRRLAQNREAARKSRLRKKAYVQQLETSRLKLIHLEQELDRARQQGFYVGNGVDTNALSFSDNMSSGIVAFEMEYGHWVEEQNRQICELRTVLHGQVSDIELRSLVENAMKHYFQLFRMKSAAAKIDVFYVMSGMWKTSAERFFLWIGGFRPSELLKVLLPHFDPLTDQQLLDVCNLRQSCQQSEDALSQGMEKLQHTLAESVAAGKLGEGSYIPQMTCAMERLEALVSFVNQADHLRHETLQQMHRILTTRQAARGLLALGEYFQRLRALSSSWAARQREPT

SEQ ID NO: 2029 - DNA, 1638 bp, Arabidopsis thaliana
  G558  Predicted polypeptide sequence is paralogous to G1198
ggaatttcggatcgtgtctctctctgtttctttgtttcaatccgatttcgaatcaagccctttacttgtgcaccttcaagatttcgttttttccagcgcccagaatgctccgggtgaccaacatttgttcctgattcatttcctattggttcgtattgtctgtgcacacaagagaaatttcaagaagttgttactaaaagagaggccacaagtggatattgtctttgttatcaagtgttagtacagaaaagtggtgagaaagtaatatggctgataccagtccgagaactgatgtctcaacagatgacgacacagatcatcctgatcttgggtcggagggagcactagtgaatactgctgcttctgattcgagtgaccgatcgaagggaaagatggatcaaaagactcttcgtaggcttgctcaaaaccgtgaggcagcaaggaaaagcagattgaggaagaaggcttatgttcagcagctagagaacagccgcttgaaactaacccagcttgagcaggagctgcaaagagcaagacagcagggcgtcttcatttcaggcacaggagaccaggcccattctactggtggaaatggtgctttggcgtttgatgctgaacattcacggtggttggaagaaaagaacaagcaaatgaacgagctgaggtctgctctgaatgcgcatgcaggtgattctgagcttcgaataatagtcgatggtgtgatggctcactatgaggagcttttcaggataaagagcaatgcagctaagaatgatgtctttcacttgctatctggcatgtggaaaacaccagctgagagatgtttcttgtggctcggtggatttcgttcatccgaacttctaaagcttctggcgaatcagttggagccaatgacagagagacagttgatgggcataaataacctgcaacagacatcgcagcaggctgaagatgctttgtctcaagggatggagagcttacaacagtcactagctgatactttatcgagcgggactcttggttcaagttcatcagggaatgtcgcaagctacatgggtcagatggccatggcaatgggaaagttaggtacactcgaaggatttatccgccaggctgataatttgagactacaaacattgcaacagatgataagagtattaacaacgagacagtcagcacgtgctctacttgcaatacacgattacttctcacggctacgagctctaagctccttatggcttgctcgacccagagagtgaaactgtattttggtcacatgtcagctgtacaaaatccatatggacacaaaaccaggagagactattaatcaacacttgtcagattcttcttaccaaatccatcaacaaataagcaaatttctgggaaacaaaagactctttgtatgtaggtttcttctacatggttgtggtaattcatgttgttttagttgtagtcatcagtttttaatttagcatttgaaaagttcaatgttgtttatatagcatcttcgattatcttagaaaggttattgaattttgtttttttttgttacttttgtgtgtggtaaaggtgttttaaccttgcaacttctgtactgtaatcatttaacaatattaagatgttctatttgagttttgt

SEQ ID NO: 2030 - protein, 330 aa, Arabidopsis thaliana
  G558  Paralogous to G1198
MADTSPRTDVSTDDDTDHPDLGSEGALVNTAASDSSDRSKGKMDQKTLRRLAQNREAARKSRLRKKAYVQQLENSRLKLTQLEQELQRARQQGVFISGTGDQAHSTGGNGALAFDAEHSRWLEEKNKQMNELRSALNAHAGDSELRIIVDGVMAHYEELFRIKSNAAKNDVFHLLSGMWKTPAERCFLWLGGFRSSELLKLLANQLEPMTERQLMGINNLQQTSQQAEDALSQGMESLQQSLADTLSSGTLGSSSSGNVASYMGQMAMAMGKLGTLEGFIRQADNLRLQTLQQMIRVLTTRQSARALLAIHDYFSRLRALSSLWLARPRE

SEQ ID NO: 2031 - DNA, 978 bp, Arabidopsis thaliana
  G578  Predicted polypeptide sequence is paralogous to G1198
atgcatagtttgaatgaaacagtaattcctgatgttgattacatgcagtctgatagagggcatatgcatgctgctgcctctgattccagtgatcgatcaaaggataagttggatcaaaagacccttcgtaggcttgctcaaaatcgtgaggcagcaagaaaaagcagattgaggaagaaggcgtatgttcagcagctggaagatagtcgattaaagctgactcaagttgagcaggagctgcaaagagcaagacagcagggagttttcatctcaagttcaggagaccaagctcattctactggtggcaatggtggggctttggcatttgatgcagaacactcacgatggcttgaagaaaagaacaggcaaatgaacgagctgagatctgccctgaatgctcatgcaggtgatactgagctccggataattgtggatggagtgatggctcactatgaggagcttttcaggattaagagcaatgcatctaagaatgatgtcttccacttgttatctggaatgtggaaaacaccagctgagcgatgtttcttgtggcttggcgggttcccgtcatccgaacttctcaagcttcttgcgaatcagctagagcccatgacagaacgacaggtaatgggcatcaatagcttgcagcagacgtcgcagcaggcagaagatgctttatctcaagggatggagagtttacagcaatccctagctgatactttatccagtggaactcttggttccagttcatcggataatgtcgcgagctacatgggtcagatggccatggcaatgggcaagttaggcaccctcgaaggattcatacgccaggctgataacttgaggctgcaaacactacaacagatgcttcgagtattaacaacacgtcagtcagctcgtgctcttcttgctatacacgattattcatctcgattacgtgctcttagttccttgtggcttgcccggccaagagagtga

SEQ ID NO: 2032 - protein, 325 aa, Arabidopsis thaliana
  G578  Paralogous to G1198
MHSLNETVIPDVDYMQSDRGHMHAAASDSSDRSKDKLDQKTLRRLAQNREAARKSRLRKKAYVQQLEDSRLKLTQVEQELQRARQQGVFISSSGDQAHSTGGNGGALAFDAEHSRWLEEKNRQMNELRSALNAHAGDTELRIIVDGVMAHYEELFRIKSNASKNDVFHLLSGMWKTPAERCFLWLGGFPSSELLKLLANQLEPMTERQVMGINSLQQTSQQAEDALSQGMESLQQSLADTLSSGTLGSSSSDNVASYMGQMAMAMGKLGTLEGFIRQADNLRLQTLQQMLRVLTTRQSARALLAIHDYSSRLRALSSLWLARPRE

SEQ ID NO: 2033 - DNA, 1054 bp, Arabidopsis thaliana
  G580  Predicted polypeptide sequence is paralogous to G568
ccaaaaaacaaagcattctatgctattctgttctgttctccaatgttgtcatcagcaaagcataataagatcaacaaccatagtgccttttcaatttcctcttcatcatcatcattatcaacatcatcctccctaggccataacaaatctcaagtcaccatggaagaagtatggaaagaaatcaaccttggttcacttcactaccatcggcaactaaacattggtcatgaaccaatgttaaagaaccaaaaccctaataactccatctttcaagatttcctcaacatgcctctgaatcaaccaccaccaccaccaccaccaccttcctcttccaccattgtcactgctctctatggctctctgcctcttccgcctcctgccactgtcctcagcttaaactccggtgttggattcgagtttcttgataccacagaaaatcttcttgcttctaaccctcgctcctttgaggaatctgcaaagtttggttgtcttggtaagaaaagaggccaagattctgatgatactagaggagacagaaggtataagcgtatgatcaagaacagagaatctgctgctcgttcaagggctaggaagcaggcatatacaaacgaacttgagcttgaaattgctcacttgcagacagagaatgcaagactcaagatacaacaagagcagctgaaaatagccgaagcaactcaaaaccaagtaaagaaaacactacaacggtcttccacagctccattttgagaaaaatctactatttctttttgggggagtttcaagtgtttcttatgaagatgagaaaaacagaaaaagtttgtacattttagctaagttaaatttgtggtggtaagtaatgtaaaagaaaagtgtgtgtagaagaaaagtgtctagaaaaagaaagcaactaactttcttcttcttctctggtttcctatcaactcttttgacttttgtactttttttcttctctacttaacctctattattgtaatgccaagtcaagtccttatctagctagtacatgagtttctgttttcactggttaagccat

SEQ ID NO: 2034 - protein, 234 aa, Arabidopsis thaliana
  G580  Paralogous to G568
MLSSAKHNKINNHSAFSISSSSSSLSTSSSLGHNKSQVTMEEVWKEINLGSLHYHRQLNIGHEPMLKNQNPNNSIFQDFLNMPLNQPPPPPPPPSSSTIVTALYGSLPLPPPATVLSLNSGVGFEFLDTTENLLASNPRSFEESAKFGCLGKKRGQDSDDTRGDRRYKRMIKNRESAARSRARKQAYTNELELEIAHLQTENARLKIQQEQLKIAEATQNQVKKTLQRSSTAPF

SEQ ID NO: 2035 - DNA, 2062 bp, Arabidopsis thaliana
  G586  Predicted polypeptide sequence is paralogous to G585
catgactagtcataacctttaaatcacttctgctttttttctgtttctcttttgatttattcaaagacaacaaagttttgtttttgacaaaaaatctgatctttgtttgttcgtttgtttgttacatggggatgaagaaacaatggcaaccggagaaaacagaacggtgccggacaatctaaagaaacagctcgcagtttcagttcgaaacattcaatggagttatggaatcttctggtctgtctctgcttctcaaccaggagtgttggagtggggagatggatattacaatggagacataaagacaaggaagacgattcaagcagcagaagtcaaaattgaccagttaggtcttgagagaagtgagcagcttagagagctttatgaatctctctccctcgctgaatcctcagcttccggtagctctcaggtcactagacgagcttccgccgccgctctctcaccggaggacctcaccgacaccgagtggtactacttagtatgcatgtctttcgtcttcaacatcggtgaaggaatccccggaggagcgttatccaatggagaaccaatatggctttgtaacgctgaaaccgccgatagcaaagtcttcactcgttctcttctagctaaaagtgcttcgcttcagacagtggtttgcttcccgtttcttggaggagtccttgagattggcacgaccgaacatattaaagaggacatgaacgtgatacaaagtgttaagacgttgttccttgaagctcctccatatactacaatatcgacaagatcagactatcaagaaatttttgatcccttaagtgacgataaatacactccggtgtttataaccgaagcttttccaacaacttctactagcgggtttgagtatgaacctgaggatcatgattcgttcatcaacgatggtggtgcgtctcaggtacaaagctggcagtttgtgggtgaagaaatcagtaactgcattcaccaatcgttaaattcaagcgattgcgtttcccaaacgtttgttggaacaaccgggagacttgcttgcgatccaaggaagagtaggattcaacggttaggtcagattcaagaacagagtaaccatgtaaatatggacgacgatgttcattaccaaggcgtgatatcgacgattttcaaaacaacgcatcagctaatactcggaccgcagtttcagaacttcgataagcggtctagcttcacaaggtggaagcgatcatcatctgtgaaaacattgggagagaaatcgcagaagatgataaagaagatactcttcgaggttcctttgatgaacaagaaagaagagttgttaccggacacaccagaggaaaccgggaaccatgccttgtccgagaagaaacgccgcgagaaattgaatgaacggtttatgacattgagatcaatcattccctcaattagtaagattgataaagtgtcgattcttgatgatacaattgagtatcttcaagatttacagaaacgggttcaagagttggaatcttgtagagaatctgctgatacagagacacggataacgatgatgaagaggaagaaaccggatgatgaggaggaaagagcatcagcgaattgtatgaacagcaaaaggaaggggagtgatgtgaatgtaggagaagatgaaccagctgatatcggttatgctggtctaacggataacttaaggatcagttcattaggtaacgaggtggttattgagcttagatgcgcttggagagaagggatattgcttgagataatggatgtgattagtgatctcaacttggattctcactcggttcagtcgtcaaccggagacggtttactctgcttaactgtcaattgcaagcataaagggacaaaaatagcaacaacaggaatgatccaagaggcacttcaaagggttgcatggatatgttaaggattcaaggtttagatttgacaaaattagctttttctctggtttggtttcccaattttcggtaatcagtgattctaaccgagtttttgtgattttggaaaaaaaaaaaaaaaaaaaaaaaaaaaaaaa

SEQ ID NO: 2036 - protein, 596 aa, Arabidopsis thaliana
  G586  Paralogous to G585
MATGENRTVPDNLKKQLAVSVRNIQWSYGIFWSVSASQPGVLEWGDGYYNGDIKTRKTIQAAEVKIDQLGLERSEQLRELYESLSLAESSASGSSQVTRRASAAALSPEDLTDTEWYYLVCMSFVFNIGEGIPGGALSNGEPIWLCNAETADSKVFTRSLLAKSASLQTVVCFPFLGGVLEIGTTEHIKEDMNVIQSVKTLFLEAPPYTTISTRSDYQEIFDPLSDDKYTPVFITEAFPTTSTSGFEYEPEDHDSFINDGGASQVQSWQFVGEEISNCIHQSLNSSDCVSQTFVGTTGRLACDPRKSRIQRLGQIQEQSNHVNMDDDVHYQGVISTIFKTTHQLILGPQFQNFDKRSSFTRWKRSSSVKTLGEKSQKMIKKILFEVPLMNKKEELLPDTPEETGNHALSEKKRREKLNERFMTLRSIIPSISKIDKVSILDDTIEYLQDLQKRVQELESCRESADTETRITMMKRKKPDDEEERASANCMNSKRKGSDVNVGEDEPADIGYAGLTDNLRISSLGNEVVIELRCAWREGILLEIMDVISDLNLDSHSVQSSTGDGLLCLTVNCKHKGTKIATTGMIQEALQRVAWIC

SEQ ID NO: 2037 - DNA, 1394 bp, Arabidopsis thaliana
  G596  Predicted polypeptide sequence is paralogous to G2789
taatttctctacttcagatttttttctccttagattaatttaattgagttattgtacatccctcaagctaagattctggttttgtgagttgagtggatgagaagaggagagattaactaaattagggtttcaattgtttactttttgtttgctttttatatcaagtaatggatcaggtctctcgctctcttcctccaccttttctctcaagagatctccatcttcacccacaccatcaattccagcatcagcagcagcagcagcaacagaatcacggccacgatatagaccagcaccgaatcggtgggctaaaacgtgaccgagatgctgatatcgatcccaacgagcactcttcagccggaaaagatcaaagtactcctggctccggtggagaaagcggcggcggaggaggaggagataatcacatcacgagaaggccacgtggcagaccagcgggatctaagaacaaaccaaaaccgccaatcatcatcactcgagacagcgcaaacgctctcaaatctcatgtcatggaagtagcaaacggatgtgacgtcatggaaagtgtcaccgtcttcgctcgccgtcgccaacgtggcatctgcgttttgagcggaaacggcgccgttaccaacgttaccataagacaaccagcttcagtacctggtggtggctcatctgtcgttaacttacacggacgtttcgagattctttctctctcgggatcattccttcctcctccggctccaccagctgcgtcaggtctaacgatttacttagccggtggtcagggacaggttgttggaggaagcgtggttggtccactcatggcttcaggacctgtagtgattatggcagcttcgtttggaaacgctgcgtatgagagactgccgttggaggaagacgatcaagaagagcaaacagctggagcggttgctaataatatcgatggaaacgcaacaatgggtggtggaacgcaaacgcaaactcagacgcagcagcaacagcaacaacagttgatgcaagatccgacgtcgtttatacaagggttgcctccgaatcttatgaattctgttcaattgccagctgaagcttattggggaactccgagaccatctttctaaatcgcgaagaaaaaacaagttagatacgttcgttgtttttaatttataatctctcttctgtcaagttttaattttctttttcttcttctttgttttctaaagataattgtagtctttgacgaagattcgtggtacgtatgaatcgaagagaatcgttttggtcatgggattgctcgatctattaggtttgagagggggtttgtgttttgcgttgactagcagattataaaattgttgattttcgagtttttattttcatgtgttggtgataaa

SEQ ID NO: 2038 - protein, 317 aa, Arabidopsis thaliana
  G596  Paralogous to G2789
MDQVSRSLPPPFLSRDLHLHPHHQFQHQQQQQQQNHGHDIDQHRIGGLKRDRDADIDPNEHSSAGKDQSTPGSGGESGGGGGGDNHITRRPRGRPAGSKNKPKPPIIITRDSANALKSHVMEVANGCDVMESVTVFARRRQRGICVLSGNGAVTNVTIRQPASVPGGGSSVVNLHGRFEILSLSGSFLPPPAPPAASGLTIYLAGGQGQVVGGSVVGPLMASGPVVIMAASFGNAAYERLPLEEDDQEEQTAGAVANNIDGNATMGGGTQTQTQTQQQQQQQLMQDPTSFIQGLPPNLMNSVQLPAEAYWGTPRPSF

SEQ ID NO: 2039 - DNA, 1263 bp, Arabidopsis thaliana
  G605  Predicted polypeptide sequence is paralogous to G1944
aattccatcctaataattttcaaagctttaattctaagaaataatatctacaagaaaatattatctcatgtatggagactaccggagaagttgttaaaacaaccaccgggagcgacggaggcgttacggtggtgagatccaacgcgccgtcagacttccacatggctccgaggtcagaaacttcaaacacacctcccaactccgtcgctcctcctcctcctccaccgccgcaaaactcctttactccgtcggcggctatggatggtttctcaagcggaccgataaagaagagacgtgggcgccctaggaagtacggacacgacggagcagcggtgacgctatctccgaatccgatatcatcagccgcaccaacgacttctcacgtcatcgatttctcgacgacatcggagaaacgtggcaaaatgaaaccagcaactccaactccaagctcattcatcaggccaaagtaccaggtcgagaatttaggtgaatggtctccttcctctgccgccgctaatttcacgccgcatattattacggtgaatgcaggcgaggacgttacgaagaggataatatcattttctcaacaagggtctctagctatttgcgttttatgcgcaaacggtgtcgtttcgagcgttacacttcgtcagcctgattcatctggtggtacattgacctatgagggtcggtttgagatattgtcactatctggaacattcatgcctagtgactcagacgggacacgaagcagaacaggcgggatgagcgtgtcgcttgctagccctgatggacgtgtagtaggtggtggtgttgctggcttgctggttgcagccactcctattcaagtggttgtaggaactttcttaggtggaacaaaccagcaagaacagacaccgaagccgcataaccacaacttcatgtcttctccattaatgccaacttcttcgaatgtagctgatcatcgaaccatccgtcccatgacatctagtctcccgatcagtacatggacaccgtcttttccttctgattcacgacacaagcattctcatgactttaatatcactttgacgtgatttcttccttgaagaactcgtagatcctctgtattttggtttccagtttagggctctacatgttagactctcaaagtctaggtgttatgttggtctgtcacttaggattgtcacttaggattgttagaccatctccatcaatggtttctcattgagaaactgttcaatataaaaataaaatataatc

SEQ ID NO: 2040 - protein, 334 aa, Arabidopsis thaliana
  G605  Paralogous to G1944
METTGEVVKTTTGSDGGVTVVRSNAPSDFHMAPRSETSNTPPNSVAPPPPPPPQNSFTPSAAMDGFSSGPIKKRRGRPRKYGHDGAAVTLSPNPISSAAPTTSHVIDFSTTSEKRGKMKPATPTPSSFIRPKYQVENLGEWSPSSAAANFTPHIITVNAGEDVTKRIISFSQQGSLAICVLCANGVVSSVTLRQPDSSGGTLTYEGRFEILSLSGTFMPSDSDGTRSRTGGMSVSLASPDGRVVGGGVAGLLVAATPIQVVVGTFLGGTNQQEQTPKPHNHNFMSSPLMPTSSNVADHRTIRPMTSSLPISTWTPSFPSDSRHKHSHDFNITLT

SEQ ID NO: 2041 - DNA, 2311 bp, Arabidopsis thaliana
  G610  Predicted polypeptide sequence is paralogous to G849
tcttaatcagagattcgtgagaggtaaaggtagcgtaattattcagtttgcgtgatctataatttaactggcgccagattgtgatccaggaatcgttggcttgttaggttgttgttttgttatgcataattgagagatggtggtcaaaaggaagttaaattgtggtggctctgatggttttgatttccccaatattcccaaggctcctcgttcaagcaggaggaaggtctcaggtaagagatctgatgatgaaagtgagatctgtgcaattgatttgctagcttctcttgctggaaagttgttggaagaaagtgaaagttcctcaacgtctacctatgcatctgaagctgataatcttgatcatttgggtggactgattaagcaagaacttgaagatggctatactactaagccttgtaaatccgagtttttcgatccaggaaaccctgcttcaaagtccactagtgaaaatactagcgtgacttgtttgccattttcgtctttcgaaaatgattgcattttggagcaaacaccggtttctgattgtaagagggcatctggtttgaagtccctggtagggagcatcactgaggagacatgtgttgttaatgaggatgccggatctgaacaaggtgctaatactttcagcttaaaggatccaagtcaattacattcgcagtctccagaatcggtccttctggatggcgatgtgaaattagcaccatgcacggatcaagtccctaatgattcttttaaaggatataggaatcattctaagttagtttgcagagatgatgacgaaaactattgtaagtattataaatttagtgacaaatgtaagtcatataggcctctctcccgggttggcaatagaagaataatgcagtcggtgagagcaatctccaagttgaagtgttttgaagacactagaacagatggtcgtttgaaggctctctaccgcaagagaaaattatgttatggttacaacccatggaagcgtgagaccattcataggaagagaagattgtctgacaaaggtttggtcgtaaattatgatggtgggctcagtagtgaaagtgtttccaattcacctgaaaagggagaatcagaaaatggtgatttctctgctgcaaaaataggtcttctttcgaaagactcccgtgtaaagttcagcatcaagtcccttaggattccggagcttgtaattgaagttccagaaacagcaacagtaggcttactgaagaggacggtgaaggaggcggttactgctttactcggtggtggaatacgtattggggtgttagtccaagggaaaaaagttagagatgacaacaacactctatcacagactggtctttcgtgtagagaaaatcttggcaaccttggcttcaccttagagcctggtttggaaacactgcctgtacctctttgttctgaaactcctgtcctttctctgccaactgactctacaaagttgtcagaaaggtccgcagcttctccagcgttagagactggaattcctctccctccccaagatgaagattacttgattaatttgggaaatagtgtggagaacaatgatgaattagtcccacatctgagtgacataccagctgatgaacaaccttcatcagattcaagagcgctggttccagttttggccttggagtccgacgctcttgcacttgttccagttaacgagaaacctaagcgtacagagctttcacaacgcagaaccaggagaccattctctgttacagaggtagaagctctagtaagcgcagttgaagaagttgggactggaagatggcgtgatgtgaagttgcgttcttttgagaatgcaagtcatcgaacctatgtggacttgaaggacaaatggaaaacgttggttcacacagcaagtatatcaccacagcaacgaagaggagaaccagtgcctcaagaactgctagacagagtcttaggagcacataggtactggacacagcaccaaatgaaacagaacgggaaacatcaggtggctacaacaatggtggttgaagcaggttcgtccatgtaaagaaggagaatggtaataacaataactttcacttgacgactaaggaaccaaagtgggcaactgtacaaagggaaacaacaaaatacagaaacatacttaatttctgaaaagaagagtctatatttttattttttttaaatcatagccggtagaaacaagacgttccttgacacttttggttacttttatggtaggtctgttcattccaaatttctaattgatttgattatgtaatttggtggtaggaccatg

SEQ ID NO: 2042 - protein, 640 aa, Arabidopsis thaliana
  G610  Paralogous to G849
MVVKRKLNCGGSDGFDFPNIPKAPRSSRRKVSGKRSDDESEICAIDLLASLAGKLLEESESSSTSTYASEADNLDHLGGLIKQELEDGYTTKPCKSEFFDPGNPASKSTSENTSVTCLPFSSFENDCILEQTPVSDCKRASGLKSLVGSITEETCVVNEDAGSEQGANTFSLKDPSQLHSQSPESVLLDGDVKLAPCTDQVPNDSFKGYRNHSKLVCRDDDENYCKYYKFSDKCKSYRPLSRVGNRRIMQSVRAISKLKCFEDTRTDGRLKALYRKRKLCYGYNPWKRETIHRKRRLSDKGLVVNYDGGLSSESVSNSPEKGESENGDFSAAKIGLLSKDSRVKFSIKSLRIPELVIEVPETATVGLLKRTVKEAVTALLGGGIRIGVLVQGKKVRDDNNTLSQTGLSCRENLGNLGFTLEPGLETLPVPLCSETPVLSLPTDSTKLSERSAASPALETGIPLPPQDEDYLINLGNSVENNDELVPHLSDIPADEQPSSDSRALVPVLALESDALALVPVNEKPKRTELSQRRTRRPFSVTEVEALVSAVEEVGTGRWRDVKLRSFENASHRTYVDLKDKWKTLVHTASISPQQRRGEPVPQELLDRVLGAHRYWTQHQMKQNGKHQVATTMVVEAGSSM

SEQ ID NO: 2043 - DNA, 1557 bp, Arabidopsis thaliana
  G629  Predicted polypeptide sequence is paralogous to G1198
cgaaatgaaaaaattctctgtattaccagaaacgtgtttcataagcatctttaactcttcagctctcaaattcttcatgaatatctctgcttatcggatcaagtgagagcaaatgcaatttttaagagccagctattggatctataactgaagaggatatatatagagatgatgagttcttcttctccaacacaacttgcatctttaagagacatgggaatctatgagccatttcaacaaattgtcggttggggaaatgttttcaaatctgatatcaatgatcatagtcccaatactgctacttcctctattattcaggttgatcctagaattgatgatcacaacaacaacatcaagataaattatgattcttctcataaccagatcgaagcagaacaaccttctagtaatgataatcaagatgatgatggcaggattcatgataagatgaaacggcgtttagcgcagaaccgagaagcggctcgcaaaagtcgtttgagaaagaaggcttatgttcagcagttagaggaaagccggttaaagttatcgcagttagagcaagaactcgaaaaggttaagcagcagggccatttaggaccatctgggagtattaacacagggattgcatcatttgagatggaatattcacactggctacaagaacaaagcagaagagttagcgaactacgaacagcgcttcaatctcatataagcgacatagaactcaagatgctagtagagagttgcttgaaccattacgctaatcttttccgaatgaaatccgatgcagcaaaagccgatgttttctacttgatatcgggaatgtggcgaacttcaaccgaaagattcttccaatggattggagggtttcgtccatccgaacttttaaacgttgtgatgccttatcttcaaccattaacggatcaacaaatcttggaagtgagaaacctccaacaatcatcacaacaagcagaggatgctctgtctcaagggattgataaacttcaacagagtttagctgaaagcattgtgattgatgcggttatcgagtccacgcattatcccactcacatggctgcagctatagagaatcttcaagcattagaaggatttgtgaatcaagcagatcatctgaggcaacaaactttgcaacaaatggcgaagatcttaacgacaagacaatcggctcgaggtttactagctttaggagagtatcttcatagacttcgtgctcttagttctctttgggcagctcgtccacaagaaccaacttaaaagaggaacttattaaaactttaaaaacaagaaacagcagaatcaaaagtcttgaagaagcatactcatcacaaagcttggaaggatgttttaaaaaagatctttgttaattaagtagagtgagattctcttgattagaactttatggtttttgctttatgaagtatctctccagagaagattgtaaatttgggttgaaactttgtaatatattaagatccaccaaataagtttgaaatctgagcaatttgataataaaaaaaaaaaaaaaaaaaaaaaaaa

SEQ ID NO: 2044 - protein, 368 aa, Arabidopsis thaliana
  G629  Paralogous to G1198
MMSSSSPTQLASLRDMGIYEPFQQIVGWGNVFKSDINDHSPNTATSSIIQVDPRIDDHNNNIKINYDSSHNQIEAEQPSSNDNQDDDGRIHDKMKRRLAQNREAARKSRLRKKAYVQQLEESRLKLSQLEQELEKVKQQGHLGPSGSINTGIASFEMEYSHWLQEQSRRVSELRTALQSHISDIELKMLVESCLNHYANLFRMKSDAAKADVFYLISGMWRTSTERFFQWIGGFRPSELLNVVMPYLQPLTDQQILEVRNLQQSSQQAEDALSQGIDKLQQSLAESIVIDAVIESTHYPTHMAAAIENLQALEGFVNQADHLRQQTLQQMAKILTTRQSARGLLALGEYLHRLRALSSLWAARPQEPT

SEQ ID NO: 2045 - DNA, 984 bp, Arabidopsis thaliana
  G659  Predicted polypeptide sequence is paralogous to G1323
atggggaagggaagagcaccttgttgtgacaagaccaaagtgaagagaggtccatggagcccagaagaagacattaaactcatctctttcattcaaaagtttggtcatgagaactggagatctctccccaaacaatctggtatgtcattgcttttgtcatcacaatcaaagcaaaagcctcttcaattgttttttcttttctttatgattctgaatgtatatatatgcaaaaatgaagggctattgaggtgtgggaagagttgtcgtctaaggtggattaactatcttaggccagatctgaagcgtggcaacttcacttcagaggaggaagaaacaatcattaagcttcaccacaactatgggaacaagtggtcgaaaatcgcttctcaacttccaggtagaacagataacgagatcaagaatgtgtggcacactcatctaaagaaaagactggctcagagctcaggaactgcagatgaaccggcctcgccttgttcgagtgattctgtttctcgtgggaaagatgataagtcatctcacgtagaagattctttgaacagagagactaatcataggaatgagttgtctacatctatgtcttctgggggttccaaccaacaagatgatccaaagatagacgaactcaggtttgagtatatagaagaagcttatagcgagtttaacgacattattattcaagaggtagacaaacccgatctgctggagataccatttgattcagatcctgacatttggagtttcttagatacttcaaactcatttcaacaatccactgcaaatgagaacagctcaggctcaagagcaacaacagaagaagagtctgatgaggatgaggttaagaaatggttcaagcacctagaaagcgaactcgggttagaagaagacgataatcaacaacaatacaaagaagaagaatcatcatcatcatcactcttgaagaactacgagctcatgatacattga

SEQ ID NO: 2046 - protein, 327 aa, Arabidopsis thaliana
  G659  Paralogous to G1323
MGKGRAPCCDKTKVKRGPWSPEEDIKLISFIQKFGHENWRSLPKQSGMSLLLSSQSKQKPLQLFFLFFMILNVYICKNEGLLRCGKSCRLRWINYLRPDLKRGNFTSEEEETIIKLHHNYGNKWSKIASQLPGRTDNEIKNVWHTHLKKRLAQSSGTADEPASPCSSDSVSRGKDDKSSHVEDSLNRETNHRNELSTSMSSGGSNQQDDPKIDELRFEYIEEAYSEFNDIIIQEVDKPDLLEIPFDSDPDIWSFLDTSNSFQQSTANENSSGSRATTEEESDEDEVKKWFKHLESELGLEEDDNQQQYKEEESSSSSLLKNYELMIH

SEQ ID NO: 2047 - DNA, 1310 bp, Arabidopsis thaliana
  G666  Predicted polypeptide sequence is paralogous to G256
attagatccatttcagagctaagcgtactaattagtgtactaagggtagtgtgactcattaccacctaaagtagtttcaattttcttctatttttcttggcaaagagttatagtgggaaacaaagggagtggttaataaagaattaattagttaattaagggagttcaagatcataatggtgaggcctccttgttgtgacaaaggaggagtgaagaaagggccatggactcctgaagaagatatcattttagtcacttacatccaagaacatggtcctggtaattggagagctgttcctaccaatactgggctgcttagatgcagtaagagttgtagacttagatggacaaactatttaaggccaggaatcaaaagaggcaatttcacagaacatgaagaaaagatgattgttcatctccaagccctcttaggaaatagatgggctgcaattgcgtcatatcttccacaaaggacagacaatgacattaagaactattggaacactcatttgaagaagaaactcaacaaagtcaatcaagattctcatcaagaacttgaccgttcctcgctctcatcttcaccatcgtcttcttctgctaattccaactcaaacatctcaagaggccaatgggaaaggcgacttcaaaccgatatccacttggcgaaaaaggctctctctgaggctttatctcctgccgttgcaccaatcattacatctacagtgacaacaacgtcttcctctgctgaatcaagacgctctacttcctcagctagcgggtttcttaggacgcaagaaacatctacaacttatgcctcaagcaccgaaaatatcgcgaaattgctcaaagggtgggtgaaaaactcgccgaagactcaaaactccgcggatcaaatcgcttctacagaggtaaaagaagtgatcaagagtgatgatgggaaggagtgtgcaggggcatttcagtcattttctgagtttgatcactcatatcaacaggctggtgtttcacctgatcatgagaccaaaccagacataactggatgctgcagtaaccaaagtcaatggtctttgtttgagaagtggttgtttgaggattctggtggacagattggtgatattctattggatgaaaacactaatttcttctgaagagtttgctttaatcacatggttctaattttaggatcctcatctctattttttttttgggttttccaaattaactcgcttagattatcgtgagataaatcagtaataattttatttattttccctctttaatttacaattaatgatggggttgcttttaaa

SEQ ID NO: 2048 - protein, 323 aa, Arabidopsis thaliana
  G666  Paralogous to G256
MVRPPCCDKGGVKKGPWTPEEDIILVTYIQEHGPGNWRAVPTNTGLLRCSKSCRLRWTNYLRPGIKRGNFTEHEEKMIVHLQALLGNRWAAIASYLPQRTDNDIKNYWNTHLKKKLNKVNQDSHQELDRSSLSSSPSSSSANSNSNISRGQWERRLQTDIHLAKKALSEALSPAVAPIITSTVTTTSSSAESRRSTSSASGFLRTQETSTTYASSTENIAKLLKGWVKNSPKTQNSADQIASTEVKEVIKSDDGKECAGAFQSFSEFDHSYQQAGVSPDHETKPDITGCCSNQSQWSLFEKWLFEDSGGQIGDILLDENTNFF

SEQ ID NO: 2049 - DNA, 1056 bp, Arabidopsis thaliana
  G668  Predicted polypeptide sequence is paralogous to G256
atgggaagaccaccttgctgtgaaaagattggagtgaagaaagggccatggacaccagaggaagacatcatcttggtttcttacatccaagaacatggtcctggaaactggagatctgtcccaacacacacaggtttaagatgtagcaagagctgcagattgagatggactaattatcttcgacccggtattaagcgtggaaattttactgagcatgaagagaagacaattgttcatcttcaagcccttttaggcaacagatgggcagccatagcatcataccttccagaaaggacagacaatgatataaagaactattggaacactcacttgaagaagaagctcaaaaagattaatgaatctggtgaagaagataatgatggtgtctcttcatcaaacactagttcacaaaagaaccatcaaagcactaacaaaggtcaatgggaaagaagacttcagacagacattaacatggcaaaacaagctctttgtgaggccttgtctttagacaaaccatcatccactctttcatcatcttcatcattaccgacaccagtaatcacacaacaaaacatccgtaacttctcatcagctttgcttgaccgttgttatgatccatcctcttcttcttcatctaccacaaccaccactacaagcaacactactaatccatacccatcaggggtatatgcgtcaagtgctgagaacatcgcccggttgcttcaagatttcatgaaagacacacccaaggctttaactttatcatcttcatctccggtttcagagactggaccactcactgctgcagtctcggaagaaggtggagaagggtttgaacaatctttcttcagcttcaattcaatggacgaaactcaaaacttgactcaggagacaagcttcttccatgatcaagtgatcaaaccggaaataacaatggaccaagatcatggtctaatatcacaagggtctctgtctttgtttgagaaatggttatttgatgagcaaagccacgagatggttggtatggcactagcaggacaagaagggatgttctag

SEQ ID NO: 2050 - protein, 351 aa, Arabidopsis thaliana
  G668  Paralogous to G256
MGRPPCCEKIGVKKGPWTPEEDIILVSYIQEHGPGNWRSVPTHTGLRCSKSCRLRWTNYLRPGIKRGNFTEHEEKTIVHLQALLGNRWAAIASYLPERTDNDIKNYWNTHLKKKLKKINESGEEDNDGVSSSNTSSQKNHQSTNKGQWERRLQTDINMAKQALCEALSLDKPSSTLSSSSSLPTPVITQQNIRNFSSALLDRCYDPSSSSSSTTTTTTSNTTNPYPSGVYASSAENIARLLQDFMKDTPKALTLSSSSPVSETGPLTAAVSEEGGEGFEQSFFSFNSMDETQNLTQETSFFHDQVIKPEITMDQDHGLISQGSLSLFEKWLFDEQSHEMVGMALAGQEGMF

SEQ ID NO: 2051 - DNA, 1384 bp, Arabidopsis thaliana
  G671  Predicted polypeptide sequence is paralogous to G2340
ttcacttgagaacaaccccctttgaactcgatcaagaaagctaagtttgaagaatcaagaatggtgcggacaccgtgttgcaaagccgaactagggttaaagaaaggagcttggactcccgaggaagatcagaagcttctctcttaccttaaccgccacggtgaaggtggatggcgaactctccccgaaaaagctggactcaagagatgcggcaaaagctgcagactgagatgggccaattatcttagacctgacatcaaaagaggagagttcactgaagacgaagaacgttcaatcatctctcttcacgcccttcacggcaacaaatggtctgctatagctcgtggactaccaggaagaaccgataacgagatcaagaactactggaacactcatatcaaaaaacgtttgatcaagaaaggtattgatccagttacacacaagggcataacctccggtaccgacaaatcagaaaacctcccggagaaacaaaatgttaatctgacaactagtgaccatgatcttgataatgacaaggcgaagaagaacaacaagaattttggattatcatcggctagtttcttgaacaaagtagctaataggttcggaaagagaatcaatcagagtgttctgtctgagattatcggaagtggaggcccacttgcttctactagtcacactactaatactacaactacaagtgtttccgttgactctgaatcagttaagtcaacgagttcttccttcgcaccaacctcgaatcttctctgccatgggaccgttgcaacaacaccagtttcatcgaactttgacgttgatggtaacgttaatctgacgtgttcttcgtccacgttctctgattcctccgttaacaatcctctaatgtactgcgataatttcgttggtaataacaacgttgatgatgaggatactatcgggttctccacatttctgaatgatgaagatttcatgatgttggaggagtcttgtgttgaaaacactgcgttcatgaaagaacttacgaggtttcttcacgaggatgaaaacgacgtcgttgatgtgacgccggtctatgaacgtcaagacttgtttgacgaaattgataactattttggatgagtgaaactcataatcgatgaatcccacgtgaccatgtcaatatgatgtctatggatatgttaccttgatgatgttgatggtaataataataaataatagatggtgatgatgaccatgcatgaatcatgaatgtagttcgtgttgtcacatatgcttgtgtttttgtgttttttttttttggtctgaagtgtgttgtttcgttgtaaatggattataaatggtgatgtaataattataatgttaaaaaaaaaaaaaaaaaaaaaaa

SEQ ID NO: 2052 - protein, 352 aa, Arabidopsis thaliana
  G671  Paralogous to G2340
MVRTPCCKAELGLKKGAWTPEEDQKLLSYLNRHGEGGWRTLPEKAGLKRCGKSCRLRWANYLRPDIKRGEFTEDEERSIISLHALHGNKWSAIARGLPGRTDNEIKNYWNTHIKKRLIKKGIDPVTHKGITSGTDKSENLPEKQNVNLTTSDHDLDNDKAKKNNKNFGLSSASFLNKVANRFGKRINQSVLSEIIGSGGPLASTSHTTNTTTTSVSVDSESVKSTSSSFAPTSNLLCHGTVATTPVSSNFDVDGNVNLTCSSSTFSDSSVNNPLMYCDNFVGNNNVDDEDTIGFSTFLNDEDFMMLEESCVENTAFMKELTRFLHEDENDVVDVTPVYERQDLFDEIDNYFG

SEQ ID NO: 2053 - DNA, 925 bp, Arabidopsis thaliana
  G714  Predicted polypeptide sequence is paralogous to G489
ccacgcgtccgcgtcaatctttgagtttggtagagaaatggatcaacaaggacaatcatcagctatgaactatggttcaaacccatatcaaaccaacgccatgaccactacaccaaccggttcagaccatccagcttaccatcagatccaccagcaacaacaacaacagctcactcaacagcttcaatctttctgggagactcaattcaaagagattgagaaaaccactgatttcaagaaccatagccttccattggcaagaatcaagaaaatcatgaaagctgatgaagatgtgcgtatgatctcggccgaggcgcctgttgtgttcgccagggcctgcgagatgtttattctggagcttacgttaaggtcttggaaccatactgaggagaacaagagaaggacgttgcagaagaatgatatcgcggctgcggtgactagaactgatatttttgattttcttgtggatattgttcctcgggaggatcttcgtgatgaagtcttgggtggtgttggtgctgaagctgctacagctgcgggttatccgtatggatacttgcctcctggaacagctccaattgggaacccgggaatggttatgggtaacccgggcgcgtatccgccgaaggcgtatatgggtcagccaatgtggcaacaaccaggacctgagcagcaggatcctgacaattagcttggcctaataaactagccgtctaattcgaagctctccccggtggatctactcaagaagaagaatgttaatagaaaactattgcgacataaaaagtttggtgtagtagaataatttctgttttatgatccatggatttatcaattgttattcagtttggtttatcttgtcatcaaactgttttcggtcaatgtaacaaattcataaattgagaattgaacttacaaaaggcta

SEQ ID NO: 2054 - protein, 217 aa, Arabidopsis thaliana
  G714  Paralogous to G489
MDQQGQSSAMNYGSNPYQTNAMTTTPTGSDHPAYHQIHQQQQQQLTQQLQSFWETQFKEIEKTTDFKNHSLPLARIKKIMKADEDVRMISAEAPVVFARACEMFILELTLRSWNHTEENKRRTLQKNDIAAAVTRTDIFDFLVDIVPREDLRDEVLGGVGAEAATAAGYPYGYLPPGTAPIGNPGMVMGNPGAYPPKAYMGQPMWQQPGPEQQDPDN

SEQ ID NO: 2055 - DNA, 1760 bp, Arabidopsis thaliana
  G729  Predicted polypeptide sequence is paralogous to G1040
aaaaaaaacaaaagaatagtcatcatcatcatcaccatcatcatccttatcatcatcaacaacttcagtggcagcaatagcaagagaaaggtttctttaattatgtctatggaaggtgtttttctagagaaaaccaaaacaaacacaacaactactctccctgatctatctctccacatcagtctcccagatattcatcaataccatcacaatgaatcttctaaagaatcttcaagaagatcctcccaactcgaaaacaacaaccgatcgtccaactttgaactctctttatctcatcataaccatccaacagcaagaatcttccattgtcctgatcgaagaacccttaatcttcctcatcagcagcattacaacaaccctatcatcaatggtgttcatcaaagggtcgatgaatccgagattagtaatctccaccgtccaattagaggcatcccggtctatcacaaccgttcattccctttccaccaacaaaactcttcattaccttctcttggaggaggagacatggatcaaatctcaatcttaaactcatcttccggctacaacaacgcttaccgatcattacaatcttccccgaggcttaaaggtgttcctttgcatcatcatcatcatcataatcagtatggagtcgttggatcttcagattcgtcttctcctcatcaccataaccatcatcatcatgggatgatcagatcaagattcttgcctaagatgccgacaaagcgaagcatgagagctccaaggatgcgttggactagtagcctccacgcgcggtttgttcacgctgttgagcttctaggcggccatgaaagagcaactccaaagtcggttcttgagctcatggatgtaaaagacttaactttagcacatgtgaagagccatttgcagatgtatcgaactgttaagaccactaacaagcctgctgcttcatcagatgggtcaggagaagaagaaatgggcataaatggaaacgaagttcatcatcaatcatcgacggatcaaagggcacaatctgatgatacttctcttcatcaagaaactgacatttcttccacacaacctcgttggagtaactcttcacgagagacatggccattaagtaataactgctcaagcgacatagatacaatgatcagaacttcatcaacatcaatgatctctcattatcaaagatccagcattcaaaatcaggagcaaaggtcgaatgatcaagcaaagaggtgtggaaatcttagttgtgaaaatccaagtttggagtttacattaggcagaccagattggcacgagaaatgactttcttgatcaatttggatttttatatatattggattttttatttttttgtttcatctttctctctctatatatactcagaaacatgtatgcagtatatatctttgtgacgatgaaattctcagcgtaaaagaaggagaacacgtagagagccaagctgctcaagagtgttgatttttgcacagagagagagaatatcactaccaaaatgaagaaatttggaggttcctcttctcaagttccattgatgatttgattataaagtggatgatcaatgtatgagtttttgtttttgggttttcgggtttttagttttttgaggttgatctggtggtgtgatcataagttatataattggaagatcatcaaaatgtggtgaaagtttggatatttttttgaaagcctcttggttggctagagggtttcaagttttttttttttttttt

SEQ ID NO: 2056 - protein, 403 aa, Arabidopsis thaliana
  G729  Paralogous to G1040
MSMEGVFLEKTKTNTTTTLPDLSLHISLPDIHQYHHNESSKESSRRSSQLENNNRSSNFELSLSHHNHPTARIFHCPDRRTLNLPHQQHYNNPIINGVHQRVDESEISNLHRPIRGIPVYHNRSFPFHQQNSSLPSLGGGDMDQISILNSSSGYNNAYRSLQSSPRLKGVPLHHHHHHNQYGVVGSSDSSSPHHHNHHHHGMIRSRFLPKMPTKRSMRAPRMRWTSSLHARFVHAVELLGGHERATPKSVLELMDVKDLTLAHVKSHLQMYRTVKTTNKPAASSDGSGEEEMGINGNEVHHQSSTDQRAQSDDTSLHQETDISSTQPRWSNSSRETWPLSNNCSSDIDTMIRTSSTSMISHYQRSSIQNQEQRSNDQAKRCGNLSCENPSLEFTLGRPDWHEK

SEQ ID NO: 2057 - DNA, 1182 bp, Arabidopsis thaliana
  G730  Predicted polypeptide sequence is paralogous to G1040
ctttttgaaataaataacattatacccctcctttttcccataaaattcatcaagattatctcaaaatcattcaccaattctctcttcttatggagcttttcccttcacaacctgacttgtacttgaagatcagccgaagaagagaagaagaacaagaaaaagaaagtcaagaactacaagaacaagaagtcgaaaggagattagggtttcagagtaaagcctcagatttagacaacaagtcttcaaataatctcatccacactctccagttcacttcaaacaatgaagccaccaagattaatagtaatcaagaacacaaggaatctctcgatcaagacttgagatctatttttatgatgagaccaataagaggaatccctctttaccagaatcaagtccttgaccactactactactcatctacctctcccaatcctttcttcttcagtgaagtcaacggtcaacatgctagtcgtcgcttaatcacaaaccctaattgtagttttaatctccacaaccgtcatcggcgtcaagctcaaccgcagccgccaagattcaccgccaaaagaggagtaagggctccaaggatgcggtggacgacgaccctccacgcccattttgtacacgctgttcaattattgggtggtcatgaaagagcaaccccaaaatcagtacttgagctgatggatgtgcaagatctcacattggctcatgttaaatcccatctacagatgtatcgaaccatcaagtctactgaaaaacctacaacgtcatcagggcagtcagattgtgagaatggatcacaagtaaacagtgagagagaagcaagaaatctcacgggtctatggaataactcctcaagtgaagctcggttccagttgaaggcaaaggcatcatcaggtgtagacatttcatccaatgagaatgaatggaagaatcgaagatgtccaagcaacgaacggttgtcgtcagattcgtcaagccttacagggacaagaccagagactgaaactcccaatcttgatttcactttagctacaccaaacctctctccctaattttcttatatatactaaaaatacatattatctgttaaaaattatataaatctcaaacttaaaagtttatgcttttgaaaaaatatatatgaaatgacgtttatttcttccttaaaaaaaaaaa

SEQ ID NO: 2058 - protein, 322 aa, Arabidopsis thaliana
  G730  Paralogous to G1040
MELFPSQPDLYLKISRRREEEQEKESQELQEQEVERRLGFQSKASDLDNKSSNNLIHTLQFTSNNEATKINSNQEHKESLDQDLRSIFMMRPIRGIPLYQNQVLDHYYYSSTSPNPFFFSEVNGQHASRRLITNPNCSFNLHNRHRRQAQPQPPRFTAKRGVRAPRMRWTTTLHAHFVHAVQLLGGHERATPKSVLELMDVQDLTLAHVKSHLQMYRTIKSTEKPTTSSGQSDCENGSQVNSEREARNLTGLWNNSSSEARFQLKAKASSGVDISSNENEWKNRRCPSNERLSSDSSSLTGTRPETETPNLDFTLATPNLSP

SEQ ID NO: 2059 - DNA, 905 bp, Arabidopsis thaliana
  G767  Predicted polypeptide sequence is paralogous to G519
cgaagtttcaactttcaaacatatctttacagttctttcttgctaaacaacaataaaggggaaaataggttaattatgatgaaatctggggctgatttgcaatttccaccaggatttagatttcatcctacggatgaggagctagtcctcatgtatctctgtcgtaaatgcgcgtcgcagccgatccctgctccgattatcaccgaactcgatttgtaccgatatgatccttgggaccttcccgacatggctttgtacggtgaaaaggagtggtattttttctcaccaagagatcgaaagtatccaaacggttcaagacccaaccgtgcagctggtactggatattggaaagctaccggagctgataaaccaataggtcgtcctaaaccggttggtattaagaaggctctagtgttttactcgggaaaacctccaaatggagagaaaaccaattggattatgcacgaataccggctcgctgacgttgaccggtcggttcgtaagaaaaacagtctaagattggacgattgggtattgtgtcgtatatataacaagaaaggtgtcatcgagaagcgacgaagcgatatcgaggacgggttaaagcctgtgactgacacgtgtccaccggaatctgtggcgagattgatctccggctcggagcaagcggtgtcaccggaattcacgtgtagcaacggtcggttgagtaatgcccttgattttccgtttaattacgtagatgccatcgccgataacgagattgtgtcacggctattgggcgggaatcagatgtggtcgacgacgcttgatccacttgtggttaggcagggaactttctgagttgtcacgtgcgattagagttagtggaaagtggaaactatcactgtctgttttcgcacgtgtcgggc

SEQ ID NO: 2060 - protein, 253 aa, Arabidopsis thaliana
  G767  Paralogous to G519
MMKSGADLQFPPGFRFHPTDEELVLMYLCRKCASQPIPAPIITELDLYRYDPWDLPDMALYGEKEWYFFSPRDRKYPNGSRPNRAAGTGYWKATGADKPIGRPKPVGIKKALVFYSGKPPNGEKTNWIMHEYRLADVDRSVRKKNSLRLDDWVLCRIYNKKGVIEKRRSDIEDGLKPVTDTCPPESVARLISGSEQAVSPEFTCSNGRLSNALDFPFNYVDAIADNEIVSRLLGGNQMWSTTLDPLVVRQGTF

SEQ ID NO: 2061 - DNA, 2353 bp, Arabidopsis thaliana
  G839  Predicted polypeptide sequence is paralogous to G1196
tctcaatttggttcttttgccttctctttgatcttatctcttacgattgtgcagatctcaatctctatatccttggttgtgtcagattctcttagggtttattttctctcccaattttgtttgattccttgtccaaagtttcttcctttccttttgacttttttttgtggtacattgaatcagaggtgtaagagtaatagtttcataactcaaatccccaagtgtacaaattttcctcttttggttctgggtttggttgattccttgttagaaatgtaaatttagggcttttgtatctgaaaccgatcttcagacttgtgtaatcttcttgatcttcatgcaagattgataattctacaagaagaagaagaagagaaaatggctactttgactgagccatcatcatctttgagtttcacatcttctcatttctcttatggttctattgggtccaatcacttctcatcaagctcagcttctaatcctgaagttgttagtctaaccaaactcagctccaatcttgagcagcttcttagtaattcagattgtgattacagtgatgcagagatcattgttgatggtgttccagttggtgttcatagatgcattttagctgcaagaagtaagtttttccaagatttgtttaagaaagaaaagaaaatttcgaaaactgagaaaccaaagtatcagttgagagagatgttaccttatggagctgttgctcatgaagctttcttgtatttcttgagttatatatatactgggagattaaagccttttccattggaggtttcgacttgtgttgatccagtttgttctcatgattgttgtcgacctgccattgattttgttgttcaattgatgtatgcttcctctgttctccaagtgcctgagctagtttcatcttttcagcggcggctttgtaactttgtggagaagacccttgttgagaatgttcttcccattcttatggttgctttcaattgtaagttgactcagcttcttgatcagtgtattgagagagtggcgaggtcagatctttacaggttctgtattgaaaaggaagttcctcccgaagtagcagagaagattaaacagcttcgacttatatccccgcaagacgaagaaaccagtcccaagatttcggagaaattgcttgaaagaatcggtaaaattctcaaggccttggattcagatgatgttgagcttgtgaagcttcttttgactgagtcagatatcactctagatcaagccaatggtctgcattattctgttgtgtatagtgatccgaaagttgttgccgagattcttgctctggatatgggtgatgtgaactacaggaattcccggggttacacggttcttcattttgctgcgatgcgtagagagccatcgatcattatatcgcttatcgataaaggcgccaatgcatctgagtttacatctgacggacgtagcgcagttaatatattaagaagactgacaaatccaaaggattatcataccaaaacagctaaagggcgtgaatctagtaaagccaggttatgcatcgatatcttggaaagagaaatcaggaagaaccccatggttctagatacaccaatgtgttccatttctatgcctgaagatctccagatgagactgttgtacctagaaaagagagtggggcttgctcagttgttctttccaacggaagctaaagttgctatggacattggtaacgtagaaggtacaagtgagttcacgggtttgtcacctccttcgagtgggttaaccggaaacttgagtcaggttgatttaaacgaaactcctcatatgcaaacccaaagacttcttactcgtatggtggctctaatgaaaacagttgagactggtcgaaggttttttccatatggttcagaggttctagataagtacatggctgagtatatagacgacgacatcctcgacgatttccattttgagaagggatctacacatgaaagaagattgaaaagaatgagatatagagagcttaaggatgatgtccaaaaggcatatagcaaagacaaagagtctaagattgcgcggtcttgtctttctgcttcatcttctccttcttcttcttccataagagatgacctgcacaacacaacatgaaactgcaccataagtcaaatgtaattagatatctttgttaaaagggttttttctttatggatgttactcagattttatacagatgctttaggttcagtttcaataaagagagatggatagatagatgtacaagattaggagtgctgattaacccaaaacgttctaactatacgcaatcttttgttttcaatacaaaaatctaatatttaggtta

SEQ ID NO: 2062 - protein, 586 aa, Arabidopsis thaliana
  G839  Paralogous to G1196
MATLTEPSSSLSFTSSHFSYGSIGSNHFSSSSASNPEVVSLTKLSSNLEQLLSNSDCDYSDAEIIVDGVPVGVHRCILAARSKFFQDLFKKEKKISKTEKPKYQLREMLPYGAVAHEAFLYFLSYIYTGRLKPFPLEVSTCVDPVCSHDCCRPAIDFVVQLMYASSVLQVPELVSSFQRRLCNFVEKTLVENVLPILMVAFNCKLTQLLDQCIERVARSDLYRFCIEKEVPPEVAEKIKQLRLISPQDEETSPKISEKLLERIGKILKALDSDDVELVKLLLTESDITLDQANGLHYSVVYSDPKVVAEILALDMGDVNYRNSRGYTVLHFAAMRREPSIIISLIDKGANASEFTSDGRSAVNILRRLTNPKDYHTKTAKGRESSKARLCIDILEREIRKNPMVLDTPMCSISMPEDLQMRLLYLEKRVGLAQLFFPTEAKVAMDIGNVEGTSEFTGLSPPSSGLTGNLSQVDLNETPHMQTQRLLTRMVALMKTVETGRRFFPYGSEVLDKYMAEYIDDDILDDFHFEKGSTHERRLKRMRYRELKDDVQKAYSKDKESKIARSCLSASSSPSSSSIRDDLHNTT

SEQ ID NO: 2063 - DNA, 1134 bp, Arabidopsis thaliana
  G861  Predicted polypeptide sequence is paralogous to G1140
cttcttcctcctcctccatctcttctctttactctctctttaatcatctctcattcttgaatcttgatccatcaaaatcaatcccgttctcgaaagatccattaaaatcaaaacctaagctctctctcttgcttctagggtttttttgttcgttgtgatggcgagagaaaagattcagatcaggaagatcgacaacgcaacggcgagacaagtgacgttttcgaaacgaagaagagggcttttcaagaaagctgaagaactctccgttctctgcgacgccgatgtcgctctcatcatcttctcttccaccggaaaactgttcgagttctgtagctccagcatgaaggaagtcctagagaggcataacttgcagtcaaagaacttggagaagcttgatcagccatctcttgagttacagctggttgagaacagtgatcacgcccgaatgagtaaagaaattgcggacaagagccaccgactaaggcaaatgagaggagaggaacttcaaggacttgacattgaagagcttcagcagctagagaaggcccttgaaactggtttgacgcgtgtgattgaaacaaagagtgacaagattatgagtgagatcagcgaacttcagaaaaagggaatgcaattgatggatgagaacaagcggttgaggcagcaaggaacgcaactaacggaagagaacgagcgacttggcatgcaaatatgtaacaatgtgcatgcacacggtggtgctgaatcggagaacgctgctgtgtacgaggaaggacagtcgtcggagtctattactaacgccggaaactctaccggagcgcctgttgactccgagagctccgacacttcccttaggctcggcttaccgtatggtggttagagatggaacaattcaaagaagttgatggagtgaggagagtaatgtaaatctttttaactcggtagtaacaagagacaatgtctaagtagtgaattctcaaatgtttgtgtaagtttctgcctatggaagaggctttcatttttatgattttcactatgtatgatctctcttcactgcatttctggttagtaacggcttgtcaccgataaactttctcgttatggaaagttagaataaaaaaaaaaaaaaaaaaa

SEQ ID NO: 2064 - protein, 240 aa, Arabidopsis thaliana
  G861  Paralogous to G1140
MAREKIQIRKIDNATARQVTFSKRRRGLFKKAEELSVLCDADVALIIFSSTGKLFEFCSSSMKEVLERHNLQSKNLEKLDQPSLELQLVENSDHARMSKEIADKSHRLRQMRGEELQGLDIEELQQLEKALETGLTRVIETKSDKIMSEISELQKKGMQLMDENKRLRQQGTQLTEENERLGMQICNNVHAHGGAESENAAVYEEGQSSESITNAGNSTGAPVDSESSDTSLRLGLPYGG

SEQ ID NO: 2065 - DNA, 1519 bp, Arabidopsis thaliana
  G932  Predicted polypeptide sequence is paralogous to G256
ccacgcgtccgaccacttgtacctctttgtcttaagtactctttaaccctacaatttcctaagctctcaagccacaaaaaaccacaaaccgttcttcaccaatatatatatctgatcatcatcaaagtccttctctctgctcataccacaaaccgttccattcttcccctaatcacaaagtgatatttacatagagaagatagagatgggaagaccaccatgctgtgacaagattggagtgaagaaaggaccatggacaccagaggaagatatcatcttggtttcttacatccaagaacatggtcctggaaactggagatctgtgcctactcacacaggtttgaggagatgtagcaaaagctgtagattgaggtggactaattatcttcgacctgggatcaagcgtggaaatttcaccgagcatgaagagaagatgattctccatcttcaagctcttttgggaaacaggtgggcagctatagcatcatatcttccagaaaggacagacaatgatataaagaactattggaacactcatttgaagaaaaagctcaagaagatgaatgattcttgtgatagtactatcaacaatggccttgataataaagacttctccatatcaaacaaaaacactacctcacatcaaagcagcaactccagtaaaggtcaatgggagagaaggcttcagacagatatcaacatggctaaacaagctctttgtgatgccttgtctattgacaaaccacaaaacccaactaatttttctattcccgatcttggttatggtccatcatcttcttcgtcctctaccaccaccaccaccaccaccaccaccacgagaaacactaatccatacccatctggggtctatgcttcaagtgctgagaacattgctcgtttgcttcagaattttatgaaagacacaccaaagacctcggtgcccttgccggttgcagccaccgagatggctatcaccacggcagcttcgagccctagcacaaccgaaggagacggagaagggattgaccattctttgttcagcttcaactccatagatgaagctgaagagaagcctaaactaatagaccatgacattaatggtctaattacacaaggctctctttctttgttcgagaaatggctctttgatgagcaaagccacgatatgatcatcaataacatgtcactagagggtcaggaagtgttgttctagaaagcattaaagtttgacgatttgcttgaggaaccacgaggcttagttataaacaatttgtataattaagtactctttagttttgttttcaatccttattatgatcatattgcagtaattagggattttagtctttagtagtaactcttaagttttaacacatttttctctatctttttagtagtaactctttattttttccttaaatctttgtcgacgtggagatgatatcttctatgtagtagaaactcaaaagtgtacatcatctttattaatgtaacgtctttttaaaaaaaaaaaaaaaaa

SEQ ID NO: 2066 - protein, 335 aa, Arabidopsis thaliana
  G932  Paralogous to G256
MGRPPCCDKIGVKKGPWTPEEDIILVSYIQEHGPGNWRSVPTHTGLRRCSKSCRLRWTNYLRPGIKRGNFTEHEEKMILHLQALLGNRWAAIASYLPERTDNDIKNYWNTHLKKKLKKMNDSCDSTINNGLDNKDFSISNKNTTSHQSSNSSKGQWERRLQTDINMAKQALCDALSIDKPQNPTNFSIPDLGYGPSSSSSSTTTTTTTTTTRNTNPYPSGVYASSAENIARLLQNFMKDTPKTSVPLPVAATEMAITTAASSPSTTEGDGEGIDHSLFSFNSIDEAEEKPKLIDHDINGLITQGSLSLFEKWLFDEQSHDMIINNMSLEGQEVLF

SEQ ID NO: 2067 - DNA, 1022 bp, Arabidopsis thaliana
  G986  Predicted polypeptide sequence is paralogous to G881
cattaaattggctcctgtgaacctaaatttatggactatgatcccaacaccaatccgttcgaccttcatttctccggtaaacttccgaaaagagaagtctcggcttcagcttctaaagttgtagagaagaaatggttagtgaaagatgagaagagaaatatgctacaagatgaaataaaccgggttaattcggagaacaagaagctaaccgaaatgttagcaagagtctgtgagaagtactatgctcttaataatcttatggaggagttgcagagtcgaaagagtcctgaaagtgttaactttcagaacaaacagctaacggggaaacgaaaacaagaacttgatgagtttgttagctccccaattggactcagtctcggaccaatcgagaacatcaccaacgataaagcgacggtttcaaccgcttactttgctgctgagaagtctgacacaagcttgactgtgaaagatggatatcaatggaggaaatacgggcaaaagattacgagagataatccatctcctagagcttacttcagatgctcgttttcaccgtcttgtctagtcaagaagaaggtgcaacgaagtgcagaagatccatctttcttggtagccacttacgaagggacacataaccacaccggaccacatgcaagtgtgtccaggacagtgaaacttgatctagttcaaggtgggcttgaaccagttgaggaaaagaaagagagagggacgattcaagaggttttggtgcaacaaatggcttcttcgttgaccaaagatcctaagttcactgcagctcttgcgactgctatttccgggagattgatagagcattcaagaacatgaaagttctctagaacatgtatatttctgttttgttctattttgttgctcattcctagtaaaaaggtaaagatttgtttgatcttgattaggaggcatagatgtcaattttaatgtgtgtgtatataattacatcaaatctaagtatccaaaaagggtcacccccattttatcttatg

SEQ ID NO: 2068 - protein, 271 aa, Arabidopsis thaliana
  G986  Paralogous to G881
MDYDPNTNPFDLHFSGKLPKREVSASASKVVEKKWLVKDEKRNMLQDEINRVNSENKKLTEMLARVCEKYYALNNLMEELQSRKSPESVNFQNKQLTGKRKQELDEFVSSPIGLSLGPIENITNDKATVSTAYFAAEKSDTSLTVKDGYQWRKYGQKITRDNPSPRAYFRCSFSPSCLVKKKVQRSAEDPSFLVATYEGTHNHTGPHASVSRTVKLDLVQGGLEPVEEKKERGTIQEVLVQQMASSLTKDPKFTAALATAISGRLIEHSRT

SEQ ID NO: 2069 - DNA, 3832 bp, Arabidopsis thaliana
  G990  Predicted polypeptide sequence is paralogous to G1451
gtaaaatttagcagagagaagaatgaaacaaataattatagcaccgtcacgtcgccgccgtatttcgttaccggaaaaaaaaaaatcattcttcaacataaaaataaaaacagtctctttctttctatctttgtctatctttgattattctctgtgtacccatgttctgcaacagttgagcaagtgcatgccccatatctctctgtttctcatttcccgatctttgcattaatcatatacttcgcctgagatctcgattaagccagcttatagaagaagaaacggcaccagcttctgtcgttttagttagctcgagatctgtgtttctttttttcttggcttctgagcttttggcggtggtgggtttttctggagaaacccaaacgactatcaaagttttgttttttacaattttaagtgggagttatgagtggggtggattaagtaagttacaagtatgaaggagttgaagattcgaagaagcggttttgaagtcggcgagaccaagattgcgagcttatttggctgatgatttatttcagggaagaagaaataaatctgttttttttagggtttttagatttggttggtgaatgggtgggaggtggagggaaacagttaaaaaagttatgcttttagtgtctcttcttcataattacatttgggcatcttgaaatctttggatctttgaagaaacaaagttgtgttttttttttgttctttgttgtttgctttttaagttagaataaaaaatgagattatcttcagctgggtttaatcctcaacctcatgaaggagagaaaagagttcttaattctgagctctggcatgcttgtgctggtcctcttgtctcactacctcctgttggaagcagagttgtgtattttcctcaaggtcacagtgaacaggttgctgcttcgaccaacaaagaagtagatgctcatataccaaattatccgagcttgcatccgcagcttatctgtcagcttcataatgttacaatgcatgctgatgtggagactgatgaagtctatgcacagatgactttgcaaccgttgaatgcgcaagagcaaaaagatccttaccttcccgcggaattaggtgtcccaagtagacagcctacaaactatttctgtaaaactctgactgctagtgatacaagcactcacggaggtttttctgtacctcgccgagctgctgagaaagttttccctcccttggattactcgcagcagccaccagctcaagagttaatggcgagggatctgcatgataatgaatggaagttcaggcatattttccgaggccaaccaaagagacatctccttaccacgggttggagcgtatttgtgagtgctaaaaggcttgttgctggtgactctgttcttttcatctggaacgataagaatcaattacttcttggtataagacgagccaaccgaccacaaactgtcatgccttcatctgttttgtcaagtgacagtatgcatttaggccttcttgctgcagcagctcatgctgccgctacaaacagccgattcaccatcttctataacccgagggcgagtccatcagagtttgttatacccctggctaagtatgtgaaagcggtttatcacactcgcgtctctgttggtatgcggtttaggatgctgtttgaaactgaagaatctagtgttcgtcggtacatgggtacaataactggcatttgtgatctagatcctactcgttgggctaattcgcattggcgatctgtcaaggttgggtgggacgaatctactgcaggagagagacagccaagggtttcattgtgggagattgagcctttaacaacattccctatgtatccatctccttttcctctcaggcttaaacggccgtggcctcctggtctcccatctttccatggccttaaagaagatgatatgggtatgagtatgagttcaccgcttatgtgggatcgaggactccaatctctaaactttcaaggtatgggagtaaacccgtggatgcagccgagacttgatacgtcgggcttgcttggtatgcaaaatgatgtgtaccaagcaatggctgcagctgcccttcaagacatgagaggcattgatcctgcaaaagctgctgcttcacttcttcagttccaaaattcgccggggttctcaatgcaatctccgtccttagtgcagccgcagatgctgcagcagcaactctctcagcagcagcaacaactctctcagcagcagcagcagcagcaacagctctcccaacagcagcagcaacagctctctcaacagcagcagcagcagctctctcaacagcagcagcaacaactctctcagcagcagcagcaacaggcgtatcttggcgttcctgaaacccaccagcctcagtctcaggctcaatcacagtcaaacaatcatctttctcagcagcagcagcaagtagtggataatcataatccgtctgcgtccagtgctgctgttgtttccgctatgtctcaatttggttctgcttctcagcccaacacgtcaccactccagtccatgacctctctgtgtcatcagcaaagcttctccgataccaacggaggaaacaatcctatttctccacttcacactcttctcagtaacttctctcaagacgaatcttctcaactgctccacctcactagaacaaactctgcaatgacttcatccggttggccatcaaagcgtcctgcagttgattcatcgttccagcactctggagccggtaataataacactcaatccgtattggagcaactgggacagtcccacacaagcaacgttcctccaaacgctgtctcgttgcctccatttcccggtggtagagagtgctcgatcgagcaagaaggaagcgcctcagacccgcatagccatcttctctttggagtcaatatagattcatcttctcttttgatgccgaacggaatgtcaaaccttagaagcattggtattgaaggtggtgactccacgactttacccttcacatcatctaatttcaacaatgatttctcgggtaatcttgcaatgacaacaccttctagttgcatagatgaatcgggttttctacaatcctcagaaaacctcggttccgagaacccacaatctaacacctttgtgaaggtgtacaagtcagggtcttttggaagatcgttagatatatcaaagtttagcagctaccacgagctgcgaagcgagcttgctcgcatgtttggcctcgaaggccaattagaagaccctgtgagatcaggctggcagcttgtatttgttgaccgagagaacgacgttcttctcctcggcgatgacccttggccggagtttgtgagcagcgtgtggtgcattaagatactgtcaccacaagaagtgcaacaaatgggaaaaagaggccttgagcttctcaactccgcgccatcttccaacaatgtcgataagctcccgagcaacgggaactgtgacgactttgggaaccggtcagacccgaggaatctcggtaacggtatcgcatcagttgggggttcattcaactactagaagtagatggaaacctccctttttattcaagttaagtttcaatcttataaattagtagtgagatcatcttagtttaattactagcaaaaatctctctttattacttataaaaaagggagatttgcctttgcctttgatggaaacaaaaactatataatccctctgtcgactcgtaatactgtaattataagatcttttggtctttttcttatatgaatatttttactgaactctatatatgtcactttccttaaaaaaaaaaaaaaaaaaaaaaaaaa

SEQ ID NO: 2070 - protein, 933 aa, Arabidopsis thaliana
  G990  Paralogous to G1451
MRLSSAGFNPQPHEGEKRVLNSELWHACAGPLVSLPPVGSRVVYFPQGHSEQVAASTNKEVDAHIPNYPSLHPQLICQLHNVTMHADVETDEVYAQMTLQPLNAQEQKDPYLPAELGVPSRQPTNYFCKTLTASDTSTHGGFSVPRRAAEKVFPPLDYSQQPPAQELMARDLHDNEWKFRHIFRGQPKRHLLTTGWSVFVSAKRLVAGDSVLFIWNDKNQLLLGIRRANRPQTVMPSSVLSSDSMHLGLLAAAAHAAATNSRFTIFYNPRASPSEFVIPLAKYVKAVYHTRVSVGMRFRMLFETEESSVRRYMGTITGICDLDPTRWANSHWRSVKVGWDESTAGERQPRVSLWEIEPLTTFPMYPSPFPLRLKRPWPPGLPSFHGLKEDDMGMSMSSPLMWDRGLQSLNFQGMGVNPWMQPRLDTSGLLGMQNDVYQAMAAAALQDMRGIDPAKAAASLLQFQNSPGFSMQSPSLVQPQMLQQQLSQQQQQLSQQQQQQQQLSQQQQQQLSQQQQQQLSQQQQQQLSQQQQQQAYLGVPETHQPQSQAQSQSNNHLSQQQQQVVDNHNPSASSAAVVSAMSQFGSASQPNTSPLQSMTSLCHQQSFSDTNGGNNPISPLHTLLSNFSQDESSQLLHLTRTNSAMTSSGWPSKRPAVDSSFQHSGAGNNNTQSVLEQLGQSHTSNVPPNAVSLPPFPGGRECSIEQEGSASDPHSHLLFGVNIDSSSLLMPNGMSNLRSIGIEGGDSTTLPFTSSNFNNDFSGNLAMTTPSSCIDESGFLQSSENLGSENPQSNTFVKVYKSGSFGRSLDISKFSSYHELRSELARMFGLEGQLEDPVRSGWQLVFVDRENDVLLLGDDPWPEFVSSVWCIKILSPQEVQQMGKRGLELLNSAPSSNNVDKLPSNGNCDDFGNRSDPRNLGNGIASVGGSFNY

SEQ ID NO: 2071 - DNA, 1239 bp, Arabidopsis thaliana
  G993  Predicted polypeptide sequence is paralogous to G867, G1930
caaatatggaatacagctgtgtagacgacagtagtacaacgtcagaatctctctccatctctactactccaaagccgacaacgacgacggagaagaaactctcttctccgccggcgacgtcgatgcgtctctacagaatgggaagcggcggaagcagcgtcgttttggattcagagaacggcgtcgagaccgagtcacgtaagcttccttcgtcgaaatataaaggcgttgtgcctcagcctaacggaagatggggagctcagatttacgagaagcatcagcgagtttggctcggtactttcaacgaggaagaagaagctgcgtcttcttacgacatcgccgtgaggagattccgcggccgcgacgccgtcactaacttcaaatctcaagttgatggaaacgacgccgaatcggcttttcttgacgctcattctaaagctgagatcgtggatatgttgaggaaacacacttacgccgatgagtttgagcagagtagacggaagtttgttaacggcgacggaaaacgctctgggttggagacggcgacgtacggaaacgacgctgttttgagagcgcgtgaggttttgttcgagaagactgttacgccgagcgacgtcgggaagctgaaccgtttagtgataccgaaacaacacgcggagaagcattttccgttaccggcgatgacgacggcgatggggatgaatccgtctccgacgaaaggcgttttgattaacttggaagatagaacagggaaagtgtggcggttccgttacagttactggaacagcagtcaaagttacgtgttgaccaagggctggagccggttcgttaaagagaagaatcttcgagccggtgatgtggtttgtttcgagagatcaaccggaccagaccggcaattgtatatccactggaaagtccggtctagtccggttcagactgtggttaggctattcggagtcaacattttcaatgtgagtaacgagaaaccaaacgacgtcgcagtagagtgtgttggcaagaagagatctcgggaagatgatttgttttcgttagggtgttccaagaagcaggcgattatcaacatcttgtgacaaattctttttttttggtttttttcttcaatttgtttctcctttttcaatattttgtattgaaatgacaagttgtaaattaggacaagacaagaaaaaatgacaactagacaaaatagtttttgtttaaaaaaaaaaaaaaaaaaaa

SEQ ID NO: 2072 - protein, 361 aa, Arabidopsis thaliana
  G993  Paralogous to G867, G1930
MEYSCVDDSSTTSESLSISTTPKPTTTTEKKLSSPPATSMRLYRMGSGGSSVVLDSENGVETESRKLPSSKYKGVVPQPNGRWGAQIYEKHQRVWLGTFNEEEEAASSYDIAVRRFRGRDAVTNFKSQVDGNDAESAFLDAHSKAEIVDMLRKHTYADEFEQSRRKFVNGDGKRSGLETATYGNDAVLRAREVLFEKTVTPSDVGKLNRLVIPKQHAEKHFPLPAMTTAMGMNPSPTKGVLINLEDRTGKVWRFRYSYWNSSQSYVLTKGWSRFVKEKNLRAGDVVCFERSTGPDRQLYIHWKVRSSPVQTVVRLFGVNIFNVSNEKPNDVAVECVGKKRSREDDLFSLGCSKKQAIINIL

SEQ ID NO: 2073 - DNA, 913 bp, Arabidopsis thaliana
  G1006  Predicted polypeptide sequence is paralogous to G28
gataaatcaatcaacaaaacaaaaaaaactctatagttagtttctctgaaaatgtacggacagtgcaatatagaatccgactacgctttgttggagtcgataacacgtcacttgctaggaggaggaggagagaacgagctgcgactcaatgagtcaacaccgagttcgtgtttcacagagagttggggaggtttgccattgaaagagaatgattcagaggacatgttggtgtacggactcctcaaagatgccttccattttgacacgtcatcatcggacttgagctgtctttttgattttccggcggttaaagtcgagccaactgagaactttacggcgatggaggagaaaccaaagaaagcgataccggttacggagacggcagtgaaggcgaagcattacagaggagtgaggcagagaccgtgggggaaattcgcggcggagatacgtgatccggcgaagaatggagctagggtttggttagggacgtttgagacggcggaagatgcggctttagcttacgatatagctgcttttaggatgcgtggttcccgcgctttattgaattttccgttgagggttaattccggtgaacctgacccggttcggatcacgtctaagagatcttcttcgtcgtcgtcgtcgtcgtcctcttctacgtcgtcgtctgaaaacgggaagttgaaacgaaggagaaaagcagagaatctgacgtcggaggtggtgcaggtgaagtgtgaggttggtgatgagacacgtgttgatgagttattggtttcataagtttgatcttgtgtgttttgtagttgaatagttttgctataaatgttgaggcaccaagtaaaagtgttcccgtgatgtaaattagttactaaacagagccatatatcttcaatcaaaaaaaaaaaaaaaa

SEQ ID NO: 2074 - protein, 243 aa, Arabidopsis thaliana
  G1006  Paralogous to G28
MYGQCNIESDYALLESITRHLLGGGGENELRLNESTPSSCFTESWGGLPLKENDSEDMLVYGLLKDAFHFDTSSSDLSCLFDFPAVKVEPTENFTAMEEKPKKAIPVTETAVKAKHYRGVRQRPWGKFAAEIRDPAKNGARVWLGTFETAEDAALAYDIAAFRMRGSRALLNFPLRVNSGEPDPVRITSKRSSSSSSSSSSSTSSSENGKLKRRRKAENLTSEVVQVKCEVGDETRVDELLVS

SEQ ID NO: 2075 - DNA, 1354 bp, Arabidopsis thaliana
  G1008  Predicted polypeptide sequence is paralogous to G2130
gcctttttgactcttctttctctcttctactttttttcaggctctctctctatatctctatcttcttctccggttaactaaaagagaaatgaaaagccgagtgagaaaatccaagtacacggttcaccggaaaatcacatccacaccgttcgacggtttcccgaagattgtcaaaatcatagtcactgacccatgcgctactgattcttccagcgatgaggaaaacgacaacaaatctgttgctccgagggtgaaacgttatgtggatgagatcaggttctgtgacgaagatgacgaacctaaaccggcgaggaaagcgaagaaaaagtccccggcggctgcggcggagaacggtggagatttggtaaagtctgtggtgaagtatagaggagtgagacaacgaccttggggaaaatttgcggcggagattcgtgatccttcgagtcgtactagactctggcttgggacttttgcgacggcggaggaagctgctataggttacgatagagccgcgattcgaatcaaaggtcataacgctcagacgaattttctcactcctcctcctagtccgacgactgaggtgttaccggaaactccggtgattgaccttgaaactgtctctggttgtgattcggcgagggaatcgcaaatcagtctgtgttctccgacttctgttctccggtttagtcacaacgacgaaacagagtacagaacagagccaacggaagaacaaaatccgtttttcttgcctgatttgtttcgctccggagattatttttgggattccgaaattacccctgaccctttgtttctcgacgaattccaccagtccttgttaccaaacatcaacaacaacaacacagtgtgtgataaggatacgaatctgtctgatagttttccgttgggagtgatcggagatttcagctcatgggatgttgatgagtttttccaagatcatttgttggataagtaatttgatgagttcttccccagaatttttctgggtttctctttttggttgtgtgagtgagatgagtggtttgatgacaacgacggggatgaatcttagccgtccgttttccatttcgtggacggctccgatcagcggaagaagcgcaacggagtttttatttatctgtttgagaattttataatttaatttgcgagtaaatatagtaattagtgttaagattgtgagagtttaagttaattagggaggggttttgaatattggggattttgggaggtttttgtttggtttctctccaagtctgtcactatgcaaggaagcagtataaagaccgtatatatattttattattaatattgataaaagtaaaaaaaaaaaaaaaaa

SEQ ID NO: 2076 - protein, 294 aa, Arabidopsis thaliana
  G1008  Paralogous to G2130
MKSRVRKSKYTVHRKITSTPFDGFPKIVKIIVTDPCATDSSSDEENDNKSVAPRVKRYVDEIRFCDEDDEPKPARKAKKKSPAAAAENGGDLVKSVVKYRGVRQRPWGKFAAEIRDPSSRTRLWLGTFATAEEAAIGYDRAAIRIKGHNAQTNFLTPPPSPTTEVLPETPVIDLETVSGCDSARESQISLCSPTSVLRFSHNDETEYRTEPTEEQNPFFLPDLFRSGDYFWDSEITPDPLFLDEFHQSLLPNINNNNTVCDKDTNLSDSFPLGVIGDFSSWDVDEFFQDHLLDK

SEQ ID NO: 2077 - DNA, 1473 bp, Arabidopsis thaliana
  G1067  Predicted polypeptide sequence is paralogous to G1073
tctcaagcttctctctcctttttttcccatagcacatcagaatcgctaaatacgactcctatgcaaagaagaagctacttctttctcttgccctaattaatctacctaactagggtttcctcttacctttcatgagagagatcatttaacataagtcaccttttttatatcttttgcttcgtctttaatttagttctgttcttggtctgtttctatattttgtcggcttgcgtaaccgatcacaccttaatgctttagctattgtttcctcaaaatcatgagttttgacttctcgatctgagttttctttttctctctttacgctcttcttcacctagctaccaatatatgaacgagcaggatcaagaatcgagaaattgatttgagctggcgaataagcagtggtgggatagggaattagtagatgcggcggcgatggaaggcggttacgagcaaggcggtggagcttctagatacttccataacctctttagaccggagattcaccaccaacagcttcaaccgcagggcgggatcaatcttatcgaccagcatcatcatcagcaccagcaacatcaacaacaacaacaaccgtcggatgattcaagagaatctgaccattcaaacaaagatcatcatcaacagggtcgacccgattcagacccgaatacatcaagctcagcaccgggaaaacgtccacgtggacgtccaccaggatctaagaacaaagccaagccaccgatcatagtaactcgtgatagccccaacgcgcttagatctcacgttcttgaagtatctcctggagctgacatagttgagagtgtttccacgtacgctaggaggagagggagaggcgtctccgttttaggaggaaacggcaccgtatctaacgtcactctccgtcagccagtcactcctggaaatggcggtggtgtgtccggaggaggaggagttgtgactttacatggaaggtttgagattctttcgctaacggggactgttttgccacctcctgcaccgcctggtgccggtggtttgtctatatttttagccggagggcaaggtcaggtggtcggaggaagcgttgtggctccccttattgcatcagctccggttatactaatggcggcttcgttctcaaatgcggttttcgagagactaccgattgaggaggaggaagaagaaggtggtggtggcggaggaggaggaggaggagggccaccgcagatgcaacaagctccatcagcatctccgccgtctggagtgaccggtcagggacagttaggaggtaatgtgggtggttatgggttttctggtgatcctcatttgcttggatggggagctggaacaccttcaagaccacctttttaattgaattttaatgtccggaaatttatgtgtttttatcatcttgaggagtcgtctttcctttgggatatttggtgtttaatgtttagttgatatgcatatttt

SEQ ID NO: 2078 - protein, 311 aa, Arabidopsis thaliana
  G1067  Paralogous to G1073
MEGGYEQGGGASRYFHNLFRPEIHHQQLQPQGGINLIDQHHHQHQQHQQQQQPSDDSRESDHSNKDHHQQGRPDSDPNTSSSAPGKRPRGRPPGSKNKAKPPIIVTRDSPNALRSHVLEVSPGADIVESVSTYARRRGRGVSVLGGNGTVSNVTLRQPVTPGNGGGVSGGGGVVTLHGRFEILSLTGTVLPPPAPPGAGGLSIFLAGGQGQVVGGSVVAPLIASAPVILMAASFSNAVFERLPIEEEEEEGGGGGGGGGGGPPQMQQAPSASPPSGVTGQGQLGGNVGGYGFSGDPHLLGWGAGTPSRPPF

SEQ ID NO: 2079 - DNA, 1342 bp, Arabidopsis thaliana
  G1076  Predicted polypeptide sequence is paralogous to G1075
attttagtcttcctataacttcttctcaatcctctctcatatcttttttcttagtttaaatttcaataaaatagaaaaaaacatatacaaatctacagagaagagaagctttattttaatcttgtgtgtgtgtgtgtgttttatataatttttattttttttcaaattaaaatctcttctttgcttttgatgtgggcatggctggtcttgatctaggcacagcttttcgttacgttaatcaccagctccatcgtcccgatctccaccttcaccacaattcctcctccgatgacgtcactcccggagccgggatgggtcatttcaccgtcgacgacgaagacaacaacaacaaccatcaaggtcttgacttagcctctggtggaggatcaggaagctctggaggaggaggaggtcacggcgggggaggagacgtcgttggtcgtcgtccacgtggcagaccaccgggatccaagaacaaaccgaaacctccggtaattatcacgcgcgagagcgcaaacactctaagagctcacattcttgaagtaacaaacggctgcgatgttttcgactgcgttgcgacttatgctcgtcggagacagcgagggatctgcgttctgagcggtagcggaacggtcacgaacgtcagcatacgtcagccatctgcggctggagcggttgtgacgctacaaggaacgttcgagattctttctctctccggatcgtttcttcctcctccggcacctcccggagcaacgagtttgacaattttcttagccggaggacaaggtcaggtggttggaggaagcgttgtgggtgagcttacggcggctggaccggtgattgtgattgcagcttcgtttactaatgttgcttatgagagacttcctttagaagaagatgagcagcagcaacagcttggaggaggatctaacggcggaggtaatttgtttccggaggtggcagctggaggaggaggaggacttccgttctttaatttaccgatgaatatgcaaccaaatgtgcaacttccggtggaaggttggccggggaattccggtggaagaggtcctttctgatgtgtatatattgataatcattatatatataccggcggagaagcttttccggcgaagaatttgcgagagtgaagaaaggttagaaaagcttttaatggactaatgaatttcaaattatcatcgtgatttcggacattgtcttgttcatcatgttaagcttaggtttattttttgtcgtttgtagaattttatgtttgaatccttttttttttctgtgaaactctattgtgttcgtctgcgaaggaaaaaaaaattctcaaaaaaaa

SEQ ID NO: 2080 - protein, 292 aa, Arabidopsis thaliana
  G1076  Paralogous to G1075
MAGLDLGTAFRYVNHQLHRPDLHLHHNSSSDDVTPGAGMGHFTVDDEDNNNNHQGLDLASGGGSGSSGGGGGHGGGGDVVGRRPRGRPPGSKNKPKPPVIITRESANTLRAHILEVTNGCDVFDCVATYARRRQRGICVLSGSGTVTNVSIRQPSAAGAVVTLQGTFEILSLSGSFLPPPAPPGATSLTIFLAGGQGQVVGGSVVGELTAAGPVIVIAASFTNVAYERLPLEEDEQQQQLGGGSNGGGNLFPEVAAGGGGGLPFFNLPMNMQPNVQLPVEGWPGNSGGRGPF

SEQ ID NO: 2081 - DNA, 2215 bp, Arabidopsis thaliana
  G1136  Predicted polypeptide sequence is paralogous to G584
caatcactaaacgccatttgcttagctttttccctcttttgatttttcctccctacacgtcacctctctcttcttctcaccggaaaaaagtcttcacctttcaccggaaaatatcaccttttcaaccggcgtatgttcacatgaacggcacaacatcatcaatcaacttcttgacctccgacgatgacgcgtcggcggcggctatggaagctttcattggaacaaaccaccactcatctctctttcctccaccaccacaacaaccacctcagcctcagttcaacgaagatactcttcaacaacgtctccaagctttaatagaatccgccggagaaaactggacttacgctatcttctggcagatctcacacgacttcgattcatccaccggagataacacagtgatcctcggctggggagatggttactacaaaggagaggaagataaagagaagaagaagaacaacaccaacacggcggagcaagagcatcggaaaagagtaatacgtgagcttaactcgttaatctccggcggaattggggtttccgatgaatcaaacgatgaagaagtaacagatactgaatggttcttcttagtttcgatgactcaaagcttcgttaacggtgttggtctccccggagaatctttcttaaactctcgtgtgatttggttatccgggtctggtgctttaaccgggtcgggttgtgaaagagcgggtcaaggtcagatttacgggttaaagacgatggtgtgtatcgcgactcaaaacggcgtcgttgagcttggttcgtcggaggttataagtcaaagctcagatctgatgcataaagttaacaacttgtttaatttcaacaacggtggtggaaacaatggtgttgaagcttcttcgtggggttttaatctgaatccagatcaaggagagaatgatccagctttgtggattagtgaaccgacgaacaccggaatcgaatctccggcgagggttaataatggtaataactcgaattctaattctaagtctgattctcatcaaatttctaagcttgagaagaatgatattagctctgtagagaatcagaatcgtcaaagttcgtgtcttgtcgagaaagatttgacctttcaaggtgggttgttgaaatctaatgagactttgagtttctgtggtaatgagagtagtaagaagagaacttcggtatctaaagggagtaataatgatgaagggatgctttcgtttagtactgtggttagatcagctgcgaatgattcggatcattctgatcttgaagcatctgttgttaaggaagcgattgttgttgagccaccggagaagaagccgaggaaacgggggaggaaaccggcgaatgggagagaagagccgttgaatcatgttgaagcagagaggcagagaagagagaagttaaaccagagattctactctttgagagctgttgttcctaacgtttcgaagatggataaagcttcgcttctcggagacgcgatttcgtatatcaatgagcttaagtcgaagctgcagcaagcggagtctgataaagaggagattcagaagaagctagatgggatgagtaaggaagggaataatgggaaaggttgcgggtcaagggcaaaagaacggaaaagttcgaatcaagattctacggcgagttctatagaaatggagattgatgttaagatcataggttgggatgtgatgatacgtgtacaatgcggcaagaaagatcatcccggtgctaggttcatggaagcacttaaggaattggatttggaagtgaatcatgcgagtttatccgttgtgaatgatttgatgattcaacaagctacggtgaagatggggagccaatttttcaatcatgaccagctcaaagttgctttgatgacgaaagtcggagaaaactattgaacaaagttggcatatcaaagaggggaaactagtgttttcatcgatgaaatgggatcgaatttagcgggtaatgtatggtcttttgtaaagtagtaagtactcattttgcatcactcgcttcatgttgttaaatgttgttgttcattaggagaacttgcttagttcttagcttagtgttatcataagccttaagtgagaaggaagttggagactagaagaccagagagagttagcgaaataataaaatctttggttgtacttgtatgtatatatatgtatggagtaagattaagtga

SEQ ID NO: 2082 - protein, 592 aa, Arabidopsis thaliana
  G1136  Paralogous to G584
MNGTTSSINFLTSDDDASAAAMEAFIGTNHHSSLFPPPPQQPPQPQFNEDTLQQRLQALIESAGENWTYAIFWQISHDFDSSTGDNTVILGWGDGYYKGEEDKEKKKNNTNTAEQEHRKRVIRELNSLISGGIGVSDESNDEEVTDTEWFFLVSMTQSFVNGVGLPGESFLNSRVIWLSGSGALTGSGCERAGQGQIYGLKTMVCIATQNGVVELGSSEVISQSSDLMHKVNNLFNFNNGGGNNGVEASSWGFNLNPDQGENDPALWISEPTNTGIESPARVNNGNNSNSNSKSDSHQISKLEKNDISSVENQNRQSSCLVEKDLTFQGGLLKSNETLSFCGNESSKKRTSVSKGSNNDEGMLSFSTVVRSAANDSDHSDLEASVVKEAIVVEPPEKKPRKRGRKPANGREEPLNHVEAERQRREKLNQRFYSLRAVVPNVSKMDKASLLGDAISYINELKSKLQQAESDKEEIQKKLDGMSKEGNNGKGCGSRAKERKSSNQDSTASSIEMEIDVKIIGWDVMIRVQCGKKDHPGARFMEALKELDLEVNHASLSVVNDLMIQQATVKMGSQFFNHDQLKVALMTKVGENY

SEQ ID NO: 2083 - DNA, 2910 bp, Arabidopsis thaliana
  G1149  Predicted polypeptide sequence is paralogous to G1146
atgtcaaatcgtggtggtggtggtcacggcggcgctagtcgtggtcgaggaggtggacgaaggtctgaccagagacaagatcagtcttctggtcaagttgcttggccgggtttacaacaaagctacggtggtcgtggtggttctgtttccgccggtagaggtcgtggaaacgtcggaagaggtgaaaatactggagatctgacggcgacgcaagttccggttgcttctgctgtttctggcgggagaggtcgtggtaacatcggagatccgacgttttctgttgcgtcttcgtctaagacggtgtctgttgcttcttcatctaaagaggaaagtaagaatacggaggtttctgagaccatgtcgaaccttcagattacttcgacggagacgaaacctgaaatgacgtcacttcctccggcgtcatctaaagcggttacgtttccggtacggccaggacgtggtactttggggaagaaagtcatggttcgtgcgaatcatttccttgttcaagttgctgatcgtgatctctaccattacgatgtttcgatcaatcctgaggttatatcaaagacagtgaacagaaacgtgatgaaacttctggttaagaattataaagactctcacttgggagggaagtcaccagcgtatgatggaaggaaaagcctctatactgctggtccattaccttttgactcgaaagagtttgttgtgaatctggcggagaaaagagctgacggttcctctgggaaggacagaccgtttaaagttgctgtaaagaatgtgacaagcactgatctttatcagttgcaacagttccttgatcgtaagcaaagagaggctccatatgatactatccaagtgcttgatgttgttcttagggataagccctctaatgattatgtctctgttgggaggtcttttttccacactagtttgggaaaggacgcaagagatggtaggggtgagcttggagatggtattgagtactggagaggttatttccaaagtctaaggctgactcagatgggtttgtctctgaacattgacgtttcagcaagatcattttatgaaccgattgttgtcactgactttattagcaagtttctgaatataagggacttaaacaggccacttagagactcagatcgacttaaggtgaagaaagttttgaggacactgaaagttaagttgcttcactggaacggcacaaaaagtgccaaaattagtgggatttctagtctacccatcagggagctaaggttcactctggaggacaaatcagagaagacggttgttcaatattttgctgaaaaatataattatagagtgaaataccaggctctacctgctattcaaacagggagtgacacaagacccgtctacctaccaatggagctctgccaaattgacgaagggcaaagatacaccaaaaggctcaatgagaagcaagtgactgcattgctaaaagctacctgccaacgaccccctgatagagagaactcgatcaaaaacttggttgtgaaaaataattacaatgatgatctgagcaaggagtttgggatgtcagtgactacccaactagcctcgattgaagctcgtgtacttcccccaccgatgttgaagtaccatgacagtggtaaagagaaaatggtaaatccaaggctaggacagtggaacatgattgacaagaaaatggttaatggagcaaaagtcacttcttggacttgcgaatttaagcctcaacctgctattccgttcatctcttgtccccctgaacatattgaggaagctcttctcgatatccacaaaagggcacctggtctccaactgttgattgtaatattgcctgatgtgactggatcatatggaaaaataaaaaggatctgtgaaacagaattggggattgtctctcagtgttgccaacctagacaagttaataaactcaacaagcagtacatggaaaatgttgccttgaagatcaatgtcaagactgggggaaggaacactgttcttaatgatgctattagaagaaacatacctcttattactgatcgtccaaccatcatcatgggtgctgatgtgactcacccacagcctggagaggactcaagtccttctattgctgctgttgtggcctctatggactggcctgagataaacaaataccgaggattggtttctgctcaagctcatagggaagaaattattcaggacctgtataagctggttcaggatccacaacgtgggctagtccactctggtttgataagggaacatttcatagcattcaggagagctacaggccagatacctcaaaggatcatcttctatcgtgacggagtaagcgaagggcagtttagtcaggttctgctacatgagatgactgctatccgcaaggcttgtaactctctccaagagaattatgttcctcgtgttactttcgtgattgtccagaaacgtcaccacacacgtttgttccctgagcaacacgggaatcgtgatatgactgataagagtggcaatattcaaccaggtactgtcgtggacactaaaatctgtcaccctaatgaattcgacttctatttgaacagccatgctggtattcagggaacaagcaggccggcacattaccatgtacttctcgatgagaacggtttcaccgctgatcagttgcaaatgctcacaaacaacctctgctacacgtatgcgaggtgtacaaaatctgtgtcaattgtgccaccagcctactacgctcacttggctgcattccgtgcccgctactacatggagagtgagatgtctgatggaggttcgagcaggtccaggagctcaacaacaggtgtgggtcaagtcatttcgcagctcccagcaataaaagataacgtcaaggaggttatgttttattgctaa

SEQ ID NO: 2084 - protein, 969 aa, Arabidopsis thaliana
  G1149  Paralogous to G1146
MSNRGGGGHGGASRGRGGGRRSDQRQDQSSGQVAWPGLQQSYGGRGGSVSAGRGRGNVGRGENTGDLTATQVPVASAVSGGRGRGNIGDPTFSVASSSKTVSVASSSKEESKNTEVSETMSNLQITSTETKPEMTSLPPASSKAVTFPVRPGRGTLGKKVMVRANHFLVQVADRDLYHYDVSINPEVISKTVNRNVMKLLVKNYKDSHLGGKSPAYDGRKSLYTAGPLPFDSKEFVVNLAEKRADGSSGKDRPFKVAVKNVTSTDLYQLQQFLDRKQREAPYDTIQVLDVVLRDKPSNDYVSVGRSFFHTSLGKDARDGRGELGDGIEYWRGYFQSLRLTQMGLSLNIDVSARSFYEPIVVTDFISKFLNIRDLNRPLRDSDRLKVKKVLRTLKVKLLHWNGTKSAKISGISSLPIRELRFTLEDKSEKTVVQYFAEKYNYRVKYQALPAIQTGSDTRPVYLPMELCQIDEGQRYTKRLNEKQVTALLKATCQRPPDRENSIKNLVVKNNYNDDLSKEFGMSVTTQLASIEARVLPPPMLKYHDSGKEKMVNPRLGQWNMIDKKMVNGAKVTSWTCEFKPQPAIPFISCPPEHIEEALLDIHKRAPGLQLLIVILPDVTGSYGKIKRICETELGIVSQCCQPRQVNKLNKQYMENVALKINVKTGGRNTVLNDAIRRNIPLITDRPTIIMGADVTHPQPGEDSSPSIAAVVASMDWPEINKYRGLVSAQAHREEIIQDLYKLVQDPQRGLVHSGLIREHFIAFRRATGQIPQRIIFYRDGVSEGQFSQVLLHEMTAIRKACNSLQENYVPRVTFVIVQKRHHTRLFPEQHGNRDMTDKSGNIQPGTVVDTKICHPNEFDFYLNSHAGIQGTSRPAHYHVLLDENGFTADQLQMLTNNLCYTYARCTKSVSIVPPAYYAHLAAFRARYYMESEMSDGGSSRSRSSTTGVGQVISQLPAIKDNVKEVMFYC

SEQ ID NO: 2085 - DNA, 3147 bp, Arabidopsis thaliana
  G1152  Predicted polypeptide sequence is paralogous to G1146
atggtgagaaagagaagaacggatgctccatctgaaggaggtgaaggctctgggtctcgtgaagctggtccagtctcaggtggtggacgtggttcacagcgaggtggtttccagcagggaggaggacaacaccaaggtggaaggggttatactcctcaacctcaacagggaggtcgtggtggtcgtggatatgggcaaccaccacaacagcaacaacagtatggaggaccacaagagtaccaaggaagaggaagaggaggacctcctcatcaaggaggtcgaggagggtatggcggtggccgtggaggtggaccttcttctggaccaccgcagagacaatcagttcccgagctgcatcaagctacctcacctacttatcaagcggtgtcttctcagcctacactgtctgaggtgagtcctacccaggtaccagaacctactgttctggctcagcaatttgaacaactctctgttgaacaaggagctcccagtcaggcaatccagcctataccttcttctagcaaggctttcaagtttccaatgaggcctggtaaaggacagagtggaaagcgttgcattgtgaaggctaaccatttctttgctgaactgcctgataaggatttgcaccattatgatgttaccattactccggaagttacatcaaggggtgtcaatcgtgctgtgatgaaacaacttgttgataattatcgtgattctcaccttggaagtcgtcttccagcgtatgatggtcgaaaaagtctttacactgctggtccacttccctttaactccaaggagttcagaatcaatcttcttgacgaagaagtaggggctggaggtcaaagacgagaaagggaatttaaagttgtgatcaagctagttgcacgtgctgatctgcatcacctaggaatgtttttggaggggaaacaatcagatgccccacaggaagctctgcaggttcttgacattgttcttcgtgagctgccgacctctaggtatattccggtgggccggtccttttattcccctgatataggaaaaaaacaatcattgggggatggcttggagagctggcgtggattctaccaaagcattcgtcctacacagatgggcttatcactcaatattgatatgtcatcgacagccttcatagaggcaaaccctgtgattcagtttgtctgtgatttgcttaaccgggatatttcttctcgacctttatctgatgctgatcgtgttaagataaaaaaggctcttagaggtgtcaaagttgaagtgactcatcgaggaaacatgcgccggaagtaccgcatttccggtttgactgctgtggccactcgggaattgacattcccagtagatgaaagaaatactcagaaatctgttgtagaatacttccacgaaacatatggttttcgcattcagcacactcaactaccatgcttgcaagttgggaattctaataggcctaattacttaccaatggaggtatgcaagattgttgaaggccagcggtattccaaaagattgaatgagagacagatcactgctttgctgaaggttacctgtcagcgcccgatagatcgagaaaaagatatcttacagacggtgcaactcaatgattatgctaaagataattatgctcaagagtttggcatcaaaataagtacttctctggcttctgttgaggctcgtatactgcctcctccatggcttaagtaccacgagtctggaagggaagggacttgtctgccacaagttggtcaatggaacatgatgaataagaaaatgatcaatggtggaacggtgaataattggatctgcatcaacttttctaggcaagtgcaggacaatctagcgcgtacattttgtcaggaacttgctcaaatgtgttacgtatctggcatggcatttaatccggaaccagtcctcccaccagtcagtgctcgccctgagcaagtagagaaggtcttgaagactagatatcatgatgccacatcaaaactctcccaaggaaaagaaattgatctgcttattgtcattctgcccgataataatggatcattatacggtgatttgaaacgcatatgtgagactgaactcggcatagtctctcaatgttgcctgacaaagcatgtctttaagatgagcaaacaatacatggctaatgttgcgctgaagattaatgtgaaggttggaggaagaaacacagtgcttgttgatgctctatctaggcggattcctctagtcagtgatcgacccaccattatatttggtgctgatgttacccaccctcaccctggagaggattcaagcccatctattgctgctgttgtggcatctcaggattggcctgaaatcactaaatatgctggattagtttgcgctcaagcgcataggcaggagctcattcaggatctgttcaaagagtggaaggatcctcagaaaggtgtggtgactggtggcatgataaaggagttgctcatagccttccgtagatcaactgggcataaaccactaaggatcatcttctacagggatggagtcagtgagggacaattttaccaagttttgctctatgaacttgatgccatccgcaaggcctgtgcttcgctggaagcaggttatcaaccaccagtgacatttgtggtggtgcagaagcgtcatcacacgaggctgtttgctcagaaccacaatgatcgccattcggtggacagaagtgggaatattttacctggcactgttgtggactctaaaatctgccaccctacagagtttgacttttacctctgtagtcatgctggtattcagggcacttctcgacctgctcattaccacgttctttgggatgagaacaactttactgcagatggacttcaatctctgaccaataacttatgttacacgtatgcaagatgcacacgctcagtttcaattgttccccctgcatattatgcacatctagcagcttttagggctcgattctacatggagccagagacatcagacagtggctcaatggctagtgggagcatggcacgtggaggtggaatggctggtagaagcacacgcgggcctaatgtcaatgctgcagtgaggccactcccagctctgaaagagaatgtgaagcgtgtcatgttctactgctga

SEQ ID NO: 2086 - protein, 1048 aa, Arabidopsis thaliana
  G1152  Paralogous to G1146
MVRKRRTDAPSEGGEGSGSREAGPVSGGGRGSQRGGFQQGGGQHQGGRGYTPQPQQGGRGGRGYGQPPQQQQQYGGPQEYQGRGRGGPPHQGGRGGYGGGRGGGPSSGPPQRQSVPELHQATSPTYQAVSSQPTLSEVSPTQVPEPTVLAQQFEQLSVEQGAPSQAIQPIPSSSKAFKFPMRPGKGQSGKRCIVKANHFFAELPDKDLHHYDVTITPEVTSRGVNRAVMKQLVDNYRDSHLGSRLPAYDGRKSLYTAGPLPFNSKEFRINLLDEEVGAGGQRREREFKVVIKLVARADLHHLGMFLEGKQSDAPQEALQVLDIVLRELPTSRYIPVGRSFYSPDIGKKQSLGDGLESWRGFYQSIRPTQMGLSLNIDMSSTAFIEANPVIQFVCDLLNRDISSRPLSDADRVKIKKALRGVKVEVTHRGNMRRKYRISGLTAVATRELTFPVDERNTQKSVVEYFHETYGFRIQHTQLPCLQVGNSNRPNYLPMEVCKIVEGQRYSKRLNERQITALLKVTCQRPIDREKDILQTVQLNDYAKDNYAQEFGIKISTSLASVEARILPPPWLKYHESGREGTCLPQVGQWNMMNKKMINGGTVNNWICINFSRQVQDNLARTFCQELAQMCYVSGMAFNPEPVLPPVSARPEQVEKVLKTRYHDATSKLSQGKEIDLLIVILPDNNGSLYGDLKRICETELGIVSQCCLTKHVFKMSKQYMANVALKINVKVGGRNTVLVDALSRRIPLVSDRPTIIFGADVTHPHPGEDSSPSIAAVVASQDWPEITKYAGLVCAQAHRQELIQDLFKEWKDPQKGVVTGGMIKELLIAFRRSTGHKPLRIIFYRDGVSEGQFYQVLLYELDAIRKACASLEAGYQPPVTFVVVQKRHHTRLFAQNHNDRHSVDRSGNILPGTVVDSKICHPTEFDFYLCSHAGIQGTSRPAHYHVLWDENNFTADGLQSLTNNLCYTYARCTRSVSIVPPAYYAHLAAFRARFYMEPETSDSGSMASGSMARGGGMAGRSTRGPNVNAAVRPLPALKENVKRVMFYC

SEQ ID NO: 2087 - DNA, 1374 bp, Arabidopsis thaliana
  G1211  Predicted polypeptide sequence is paralogous to G291
  misc_feature (1144)..(1144): n is a, c, g, or t
  misc_feature (1209)..(1209): n is a, c, g, or t
  misc_feature (1212)..(1212): n is a, c, g, or t
  misc_feature (1238)..(1238): n is a, c, g, or t
  misc_feature (1254)..(1254): n is a, c, g, or t
  misc_feature (1260)..(1261): n is a, c, g, or t
  misc_feature (1296)..(1296): n is a, c, g, or t
  misc_feature (1322)..(1322): n is a, c, g, or t
  misc_feature (1325)..(1325): n is a, c, g, or t
  misc_feature (1360)..(1360): n is a, c, g, or t
tgaaacctagatttctgcaactgaattcctaattcgaaaaagaatggagggttcgtcgtcgacgatagcaaggaagacatgggaactagagaacagcattctaacagtagactcacctgattcaacctccgacaacatcttctactacgacgatacttcacagactaggttccagcaagagaaaccgtgggagaatgatcctcactactttaaacgagtcaagatctcagcgctcgctcttcttaagatggtggttcacgctcgctctggtggtacaattgaaataatgggtcttatgcaaggtaagaccgatggtgatactatcattgttatggatgcttttgctttaccagtggaaggtactgagacaagggttaatgctcaggatgatgcttatgagtacatggttgagtattcacagaccaacaagctcgcggggcggctggagaatgttgttggatggtatcactctcaccctggatatggatgctggctctccggtattgatgtttctacgcagacgcttaaccaacagcatcaggagccatttttagctgttgttattgatcccacaaggactgtttcagctggtaaggttgagattggtgctttcagaacatactctaaaggatataagcctccagatgaacctgtttctgagtatcaaactattcctttaaataagattgaggactttggtgttcactgcaaacagtactattcattagatgtcacttatttcaagtcatctcttgattctcaccttctggatctactatggaacaagtactgggtgaacactctttcttcttctccactgctgggtaatggagactatgttgctggacaaatatcagacttagctgagaagcttgagcaagccgagagtcatctggttcagtctcgctttggaggagttgtgccatcatcccttcataagaaaaaagaagatgagtctcaactaactaagataactcgggatagcgcaaagataactgtggaacaggtccatggactaatgtcgcaggtcataaaagatgaattattcaactcaatgcgtcagtccaacaacaaatctcccactgactcgtcggatccagaccctatgattacatattgaagttgctcttcttttggtttctanttttggattgacccatcatttgttgtcctttcatttattttctgttgtgtaaagaattataatgncgncgcgaattcgcggccgctaaaaaaanacaggaaattgaaaanaattcnnccattccaacatctttatttaatattatctcctcnattatataatattcaaacatccctantancttcatttgaccgtccccctccctcccgtgttgcnttggtgctggcccc

SEQ ID NO: 2088 - protein, 358 aa, Arabidopsis thaliana
  G1211  Paralogous to G291
MEGSSSTIARKTWELENSILTVDSPDSTSDNIFYYDDTSQTRFQQEKPWENDPHYFKRVKISALALLKMVVHARSGGTIEIMGLMQGKTDGDTIIVMDAFALPVEGTETRVNAQDDAYEYMVEYSQTNKLAGRLENVVGWYHSHPGYGCWLSGIDVSTQTLNQQHQEPFLAVVIDPTRTVSAGKVEIGAFRTYSKGYKPPDEPVSEYQTIPLNKIEDFGVHCKQYYSLDVTYFKSSLDSHLLDLLWNKYWVNTLSSSPLLGNGDYVAGQISDLAEKLEQAESHLVQSRFGGVVPSSLHKKKEDESQLTKITRDSAKITVEQVHGLMSQVIKDELFNSMRQSNNKSPTDSSDPDPMITY

SEQ ID NO: 2089 - DNA, 911 bp, Arabidopsis thaliana
  G1277  Predicted polypeptide sequence is paralogous to G24
attctaaagtcctcctctcggaaagtaagagactcaacttccgagccgccatggacgccggagtagcagtaaaagctgacgtggcagtcaaaatgaagagagaaagaccattcaaagggatcagaatgagaaaatgggggaaatgggttgcggagattcgagaacccaacaagcgttcaagactttggctcggctcttactctactcccgaagcggcggcgcgtgcatacgacacggctgtcttttacctcagaggaccaactgctacgctcaacttcccggagcttctgccgtgtacctccgccgaggatatgtcagcggcaacgatcaggaaaaaggcgacggaggtgggagctcaagtagatgcgataggggcgacggtggtgcagaacaacaaacgccgccgcgtttttagtcaaaagcgtgactttggcggcgggttattagagcttgttgacttgaacaagttacctgacccggaaaatctcgatgatgatttggtgggaaaatagactgaaaaataataataaaatatcttacaatggtggctgtagctatcgtacgcggaatgcttgggcttgtgttatatgactacgtggttacggaaagattcctctgtttcgtcattgtattaaaatttaatcccacaagtcaaacatactgtacattattcttaatttagtattttcttattaatatctatcatttgtttggtgaacaccagaatattagactattaatgtaacgagtttttaatatttcgatcataataacaccaagctagttaaaggttaatatcttgttacgaagtcttgagtaagttcaattgtcatatatatgtaacggaagaggttcgttcgggtcccaagtgaagtggatcaaaggtgacttcacataaaaaataaaaaaaa

SEQ ID NO: 2090 - protein, 153 aa, Arabidopsis thaliana
  G1277  Paralogous to G24
MDAGVAVKADVAVKMKRERPFKGIRMRKWGKWVAEIREPNKRSRLWLGSYSTPEAAARAYDTAVFYLRGPTATLNFPELLPCTSAEDMSAATIRKKATEVGAQVDAIGATVVQNNKRRRVFSQKRDFGGGLLELVDLNKLPDPENLDDDLVGK

SEQ ID NO: 2091 - DNA, 2083 bp, Arabidopsis thaliana
  G1290  Predicted polypeptide sequence is paralogous to G278
aattccactgttattagactcttgactctgttttgtttcccgccgatctcgtgatgatggccaccaccaccaccaccaccaccgctagattctctgattcatacgagttcagcaacacaagcggcaatagcttcttcgccgccgagtcatctcttgattatccgacggaatttctcacgccaccggaggtatcagctcttaaacttctgtctaactgcctcgagtctgttttcgactcgccggagacgttctacagcgatgctaagctagttctcgccggcggccgggaagtttcttttcaccgttgtattctttccgcgagaattcctgtcttcaaaagcgctttagccaccgtgaaggaacaaaaatcctccaccaccgtgaagctccagctgaaagagatcgccagagattacgaagtcggctttgactcggttgtggcggttttggcgtatgtttacagcggcagagtgaggtccccgccgaagggagcttctgcttgcgtagacgacgattgttgccacgtggcttgccggtcaaaggtggatttcatggtggaggttctttatctgtctttcgttttccagattcaagaattagttactctgtatgagaggcagttcttggaaattgtagacaaagttgtagtcgaagacatcttggttatattcaagcttgatactctatgtggtacaacatacaagaagcttttggatagatgcatagaaattatcgtgaagtctgatatagaactagttagtcttgagaagtctttacctcaacacattttcaagcaaatcatagacatccgcgaagcgctctgtctagagccacctaaactagaaaggcatgtcaagaacatatacaaggcgctagactcagatgatgttgagcttgtcaagatgcttttgctagaaggacacaccaatctcgatgaggcgtatgctcttcattttgctatcgctcactgcgctgtgaagaccgcgtatgatctcctcgagcttgagcttgcggatgttaaccttagaaatccgaggggatacactgtgcttcatgttgctgcgatgcggaaggagccgaagttgataatatctttgttaatgaaaggggcaaatattttagacacaacattggatggtagaaccgctttagtgattgtaaaacgactcactaaagcggatgactacaaaactagtacggaggacggtacgccttctctgaaaggcggattatgcatagaggtacttgagcatgaacaaaaactagaatatttgtcgcctatagaggcttcactttctcttccagtaactccagaggagttgaggatgaggttgctctattatgaaaaccgagttgcacttgctcgacttctctttccagtggaaactgaaactgtacagggtattgccaaattggaggaaacatgcgagtttacagcttctagtctcgagcctgatcatcacattggtgaaaagcggacatcactagacctaaatatggcgccgttccaaatccatgagaagcatttgagtagactaagagcactttgtaaaaccgtggaactggggaaacgctacttcaaacgatgttcgcttgatcactttatggatactgaggacttgaatcatcttgctagcgtagaagaagatactcctgagaaacggctacaaaagaagcaaaggtacatggaactacaagagactctgatgaagacctttagtgaggacaaggaggaatgtggaaagtcttccacaccgaaaccaacctctgcggtgaggtctaatagaaaactctctcaccggcgcctaaaagtggacaaacgggattttttgaaacgaccttacgggaacggggattaaggaatgggaaatcatattccatttcactcccacaactaaaaatgatgtatgtcctatatcatgatgtttcgtgagtttcaaataaattgaaacgtacatatatcagtttttcatctacgtgactgcgttgtatagttttcgttcttcacttagcatcatgtgtattctagctccaagtgcgtttcaaacaaatatagttatttttagccaattatatatacggt

SEQ ID NO: 2092 - protein, 601 aa, Arabidopsis thaliana
  G1290  Paralogous to G278
MMATTTTTTTARFSDSYEFSNTSGNSFFAAESSLDYPTEFLTPPEVSALKLLSNCLESVFDSPETFYSDAKLVLAGGREVSFHRCILSARIPVFKSALATVKEQKSSTTVKLQLKEIARDYEVGFDSVVAVLAYVYSGRVRSPPKGASACVDDDCCHVACRSKVDFMVEVLYLSFVFQIQELVTLYERQFLEIVDKVVVEDILVIFKLDTLCGTTYKKLLDRCIEIIVKSDIELVSLEKSLPQHIFKQIIDIREALCLEPPKLERHVKNIYKALDSDDVELVKMLLLEGHTNLDEAYALHFAIAHCAVKTAYDLLELELADVNLRNPRGYTVLHVAAMRKEPKLIISLLMKGANILDTTLDGRTALVIVKRLTKADDYKTSTEDGTPSLKGGLCIEVLEHEQKLEYLSPIEASLSLPVTPEELRMRLLYYENRVALARLLFPVETETVQGIAKLEETCEFTASSLEPDHHIGEKRTSLDLNMAPFQIHEKHLSRLRALCKTVELGKRYFKRCSLDHFMDTEDLNHLASVEEDTPEKRLQKKQRYMELQETLMKTFSEDKEECGKSSTPKPTSAVRSNRKLSHRRLKVDKRDFLKRPYGNGD

SEQ ID NO: 2093 - DNA, 925 bp, Arabidopsis thaliana
  G1329  Predicted polypeptide sequence is paralogous to G663
ccacgcgtccgtaccttttacaatttgtttatatattttacgtatctatctttgttccatggagggttcgtccaaagggctgcgaaaaggtgcttggactactgaagaagatagtctcttgagacagtgcattaataagtatggagaaggcaaatggcaccaagttcctgtaagagctgggctaaaccggtgcaggaaaagttgtagattaagatggttgaactatttgaagccaagtatcaagagaggaaaacttagctctgatgaagtcgatcttcttcttcgccttcataggcttctagggaataggtggtctttaattgctggaagattacctggtcggaccgcaaatgacgtcaagaattactggaacactcatctgagtaagaaacatgaaccgtgttgtaagataaagatgaaaaagagagacattacgcccattcctacaacaccggcactaaaaaacaatgtttataagcctcgacctcgatccttcacagttaacaacgactgcaaccatctcaatgccccaccaaaagttgacgttaatcctccatgccttggacttaacatcaataatgtttgtgacaatagtatcatatacaacaaagataagaagaaagaccaactagtgaataatttgattgatggagataatatgtggttagagaaattcctaaggaaagccaagaggtagatattttggttcctgaagcgacgacaacagaaaagggggacaccttggcttttgacgttgatcaactttggagtcttttcgatggagagactgtgaaatttgattagtgtttcgaacatttgtttgcgtttgtgtataggtttgctttcaccttttaatttgtgtgttttgataaataagctaatagtttttagcattttaatgaaatatttcaagtttccgtgttac

SEQ ID NO: 2094 - protein, 212 aa, Arabidopsis thaliana
  G1329  Paralogous to G663
MEGSSKGLRKGAWTTEEDSLLRQCINKYGEGKWHQVPVRAGLNRCRKSCRLRWLNYLKPSIKRGKLSSDEVDLLLRLHRLLGNRWSLIAGRLPGRTANDVKNYWNTHLSKKHEPCCKIKMKKRDITPIPTTPALKNNVYKPRPRSFTVNNDCNHLNAPPKVDVNPPCLGLNINNVCDNSIIYNKDKKKDQLVNNLIDGDNMWLEKFLRKAKR

SEQ ID NO: 2095 - DNA, 965 bp, Arabidopsis thaliana
  G1335  Predicted polypeptide sequence is paralogous to G652
tttttttttaaaagatttagagagaaaagtgagttattaagagattccaatcaaaatgagcggagacaacggcggtggtgagaggcgcaaaggctccgtcaagtggtttgatacccagaagggtttcggcttcatcactcctgacgacggtggcgacgatctcttcgttcaccagtcctccatcagatctgagggtttccgtagcctcgctgccgaagaagccgtagagttcgaggttgagatcgacaacaacaaccgtcccaaggccatcgatgtttctggacccgacggcgctcccgtccaaggaaacagcggtggtggttcatctggcggacgcggcggtttcggtggaggaagaggaggtggacgcggatctggaggtggatacggcggtggcggtggtggatacggaggaagaggaggtggtggtcgaggaggcagcgactgctacaagtgtggtgagcccggtcacatggcgagagactgttctgaaggcggtggaggttacggaggaggcggcggtggctacggaggtggaggcggatacggcggaggaggtggtggttacggaggtggtggccgtggaggtggtggcggcgggggaagctgctacagctgtggcgagtcgggacatttcgccagggattgcaccagcggtggacgttaaaaccaacgccggttacgcggtggagaagagtgagttggttatctcacaagtgatcggttctttctcccgccgccttctatctctctattatccactttttgcttattatgatggatctctatctttgttagttggttttttcttgatggtttcggattaggactcttcttttggttttgctacttatggttggttttatttatggtacttgtgatatgggtgaaatgctctacttgttgctctgtttcaagtgttcataatatgcgaacaaatattctgggttttgtttcaaaaaaaa

SEQ ID NO: 2096 - protein, 203 aa, Arabidopsis thaliana
  G1335  Paralogous to G652
MSGDNGGGERRKGSVKWFDTQKGFGFITPDDGGDDLFVHQSSIRSEGFRSLAAEEAVEFEVEIDNNNRPKAIDVSGPDGAPVQGNSGGGSSGGRGGFGGGRGGGRGSGGGYGGGGGGYGGRGGGGRGGSDCYKCGEPGHMARDCSEGGGGYGGGGGGYGGGGGYGGGGGGYGGGGRGGGGGGGSCYSCGESGHFARDCTSGGR

SEQ ID NO: 2097 - DNA, 1230 bp, Arabidopsis thaliana
  G1349  Predicted polypeptide sequence is paralogous to G896
atggctagtcggagagaagtacggtgccggtgcggcagacggatgtgggttcaaccagacgcccgtaccgtccaatgctcaacctgccacaccgtcacgcagctctactcgctagtggacatagctcgcggtgcaaaccgcataattcatgggtttcaacagctacttagacaacaccaaccgcaacatcatgaacaacaacaacaacaaatgatggctcaaccgccaccacggctgcttgagcctcttccctcgccgtttgggaagaagagagcagttttatgcggcgtgaactataagggaaaaagttatagcttgaaaggttgcatcagtgatgctaagtccatgagatctttattggttcaacaaatgggtttccctattgactctattctcatgctcacagaagatgaagccagcccgcagagaataccgacgaagagaaacattaggaaggcgatgagatggttagttgaagggaacagagcaagggactcactagtgttccatttctctggtcatggatctcagcagaatgactacaacggagacgagatcgatggtcaagatgaagccttgtgccctttagaccatgaaacagaaggaaaaatcattgatgacgagattaaccggatactcgtgaggcctctcgtccatggagctaagcttcacgctgtcatcgacgcctgtaacagcgggactgtccttgatttacccttcatttgcaggatggagaggaatggttcttatgaatgggaagaccatagatcagtcagagcttacaaaggaacagatggtggagcagctttctgtttcagtgcttgtgacgatgatgaatccagtggttacactcctgtgttcacggggaagaacacaggagccatgacttatagcttcataaaggcggtgaagacagctggaccagcacccacgtatggccacctgcttaaccttatgtgttctgcaatacgagaggcccagtctcgcctcgcctttaacggggactacacaagctctgatgcatccgcggagccactgctaacatcatctgaggaatttgacgtgtacgcgacaaagtttgtactctgaatgctgtacatatgatgctgcaaatagctcggaaacgtttctatgtgtatgtatcatgtaatgattatgttgcatagcctctctcttcttacgagcaataagctatgaaataattgattcgctaagaaatttaaaatgaaa

SEQ ID NO: 2098 - protein, 362 aa, Arabidopsis thaliana
  G1349  Paralogous to G896
MASRREVRCRCGRRMWVQPDARTVQCSTCHTVTQLYSLVDIARGANRIIHGFQQLLRQHQPQHHEQQQQQMMAQPPPRLLEPLPSPFGKKRAVLCGVNYKGKSYSLKGCISDAKSMRSLLVQQMGFPIDSILMLTEDEASPQRIPTKRNIRKAMRWLVEGNRARDSLVFHFSGHGSQQNDYNGDEIDGQDEALCPLDHETEGKIIDDEINRILVRPLVHGAKLHAVIDACNSGTVLDLPFICRMERNGSYEWEDHRSVRAYKGTDGGAAFCFSACDDDESSGYTPVFTGKNTGAMTYSFIKAVKTAGPAPTYGHLLNLMCSAIREAQSRLAFNGDYTSSDASAEPLLTSSEEFDVYATKFVL

SEQ ID NO: 2099 - DNA, 1008 bp, Arabidopsis thaliana
  G1357  Predicted polypeptide sequence is paralogous to G1452
atggcagctgcaccaccgatcgagccggcggtgacgacgacgttccctggcttcaaattctccccgaccgacatcgaacttatatcttattacttgaagaggaagatggatggtttggagagatctgttgagattatacctgaggttgagatttacaacttcgagccttgggatttacctgataagtctatcgttaaatcggatagcgaatggttcttcttctgtgctcgcggtaagaagtatccccacggttcacagaacagaagagcaaccaagataggatattggaaagccacaggaaaagagcgtaatgtgaagtcaggttctgaggtcattggaacaaagagaacgcttgtattccacattggccgcgcgccaaaaggaggaagaacggaatggcttatgcatgagtactgcatgattggagtatcactggatgctctggttatttgccgacttaggaggaatactgaatttcaagggagtacaattcaaaagccaccacaaccaagtttaccactggataagcacgtaaacttgcggaatgaagctatttcagaaagtatttatggttgggaaactatggttgatttctacttatcaagtgagtcagggcaagaactacttagtgaaatagcagaatcttcacaatcttcacaaaatccacaggttcctagtgaagaagatttctatgccgatatactgagggatgaaatagtaaagctagatgatccggcggtatccggtaatacactgatcaatgtaccaaggcttcaaacagagtccaataccacaagagtactacctttacctgacatggtagacaaacaaatgcaatcgttgctacagaaactaccattacaaaatgacactggagaagagaacaacatatccatgtcaaattgctttatcggtatctactcgattaagtctataaaccgagcgcgatgggacgttgttgtttggttactcgttatgatagccgtgttggtgttttatttagtgtga

SEQ ID NO: 2100 - protein, 335 aa, Arabidopsis thaliana
  G1357  Paralogous to G1452
MAAAPPIEPAVTTTFPGFKFSPTDIELISYYLKRKMDGLERSVEIIPEVEIYNFEPWDLPDKSIVKSDSEWFFFCARGKKYPHGSQNRRATKIGYWKATGKERNVKSGSEVIGTKRTLVFHIGRAPKGGRTEWLMHEYCMIGVSLDALVICRLRRNTEFQGSTIQKPPQPSLPLDKHVNLRNEAISESIYGWETMVDFYLSSESGQELLSEIAESSQSSQNPQVPSEEDFYADILRDEIVKLDDPAVSGNTLINVPRLQTESNTTRVLPLPDMVDKQMQSLLQKLPLQNDTGEENNISMSNCFIGIYSIKSINRARWDVVVWLLVMIAVLVFYLV

SEQ ID NO: 2101 - DNA, 537 bp, Arabidopsis thaliana
  G1364  Predicted polypeptide sequence is paralogous to G481, G482
atggcggagtcgcaggccaagagtcccggaggctgtggaagccatgagagtggtggagatcaaagtcccaggtcgttacatgttcgtgagcaagataggtttcttccgattgctaacataagccgtatcatgaaaagaggtcttcctgctaatgggaaaatcgctaaagatgctaaggagattgtgcaggaatgtgtctctgaattcatcagtttcgtcaccagcgaagcgagtgataaatgtcaaagagagaaaaggaagactattaatggagatgatttgctttgggcaatggctactttaggatttgaagactacatggaacctctcaaggtttacctgatgagatatagagagggtgacacaaagggatcagcaaaaggtggggatccaaatgcaaagaaagatgggcaatcaagccaaaatggccagttctcgcagcttgctcaccaaggtccttatgggaactctcaagtaacttttcctctcttctcttcacactcaagcaatacgcatcattctcttctaatttgttaa

SEQ ID NO: 2102 - protein, 178 aa, Arabidopsis thaliana
  G1364  Paralogous to G481, G482
MAESQAKSPGGCGSHESGGDQSPRSLHVREQDRFLPIANISRIMKRGLPANGKIAKDAKEIVQECVSEFISFVTSEASDKCQREKRKTINGDDLLWAMATLGFEDYMEPLKVYLMRYREGDTKGSAKGGDPNAKKDGQSSQNGQFSQLAHQGPYGNSQVTFPLFSSHSSNTHHSLLIC

SEQ ID NO: 2103 - DNA, 839 bp, Arabidopsis thaliana
  G1379  Predicted polypeptide sequence is paralogous to G24
ctctgcctctctctctctctcaaaacccatctcgaaagtctttctctttcgagggtttagatcctccatggaaggcggcggagttgctgacgtggctgtccccggtacgaggaagagagacagaccttacaaaggaattaggatgaggaagtggggaaagtgggtggcggagattcgtgagcctaacaagcgctctaggttatggcttggctcttactctactcccgaggcggcggcgcgagcttacgacacggcggttttctatcttagaggacctacggcgaggcttaacttccctgagcttcttcctggggagaaattctccgacgaggatatgtcggctgcgaccatcaggaagaaagccacggaggtcggtgctcaggttgatgctttgggcacggcggtgcaaaataaccgccaccgtgtttttggtcagaatcgagatagtgatgtggataataagaattttcatcggaattatcaaaacggtgaacgagaagaagaagaagaagatgaggatgacaagagattgaggagtggcggccggttattggatcgggttgacttgaataaattacccgacccggaaagctccgatgaagaatgggaaagcaaacattaaaaatatatagtttggagcggtggctgttgctaacgtacgccaacggcttgcttctacgaatcattagcgccgtttatgatttttttttttttttttttcattatctgaaaatttagggctttttagttattaatttttgttttgtttttttcctttcttgcgagttttgcggtttatggaattttaggctattgcttaacgaaaaaaaaaaaaaaaa

SEQ ID NO: 2104 - protein, 184 aa, Arabidopsis thaliana
  G1379  Paralogous to G24
MEGGGVADVAVPGTRKRDRPYKGIRMRKWGKWVAEIREPNKRSRLWLGSYSTPEAAARAYDTAVFYLRGPTARLNFPELLPGEKFSDEDMSAATIRKKATEVGAQVDALGTAVQNNRHRVFGQNRDSDVDNKNFHRNYQNGEREEEEEDEDDKRLRSGGRLLDRVDLNKLPDPESSDEEWESKH

SEQ ID NO: 2105 - DNA, 844 bp, Arabidopsis thaliana
  G1387  Predicted polypeptide sequence is paralogous to G975, G2583
tctctctcccactctcactttctctcctattcttagttcgtgtcagaaacacacagagaaattaagaaccctaatttaaaacagaagaatggtacattcgaagaagttccgaggtgtccgccagcgtcagtggggttcttgggtttctgagattcgtcatcctctcttgaagagaagagtgtggctaggaacattcgacacggcggaaacagcggctagagcctacgaccaagccgcggttctaatgaacggccagagcgcgaagactaacttccccgtcatcaaatcgaacggttcaaattccttggagattaactctgcgttaaggtctcccaaatcattatcggaactattgaacgctaagctaaggaagaactgtaaagaccagacaccgtatctgacgtgtctccgcctcgacaacgacagctcacacatcggcgtctggcagaaacgcgccgggtcaaaaacgagtccaaactgggtcaagcttgttgaactaggtgacaaagttaacgcacgtcccggtggtgatattgagactaataagatgaaggtacgaaacgaagacgttcaggaagatgatcaaatggcgatgcagatgatcgaggagttgcttaactggacctgtcctggatctggatccattgcacaggtctaaaggagaatcattgaattatatgatcaagataataatatagttgagggttaataataatcgagggtaagtaatttacgtgtagctaataattaatataattttcgaacatatatatgaatatatgatagctctagaaatgagtacgtatatatacgtaaacatttttcctcaaatatagtatatgtg

SEQ ID NO: 2106 - protein, 189 aa, Arabidopsis thaliana
  G1387  Paralogous to G975, G2583
MVHSKKFRGVRQRQWGSWVSEIRHPLLKRRVWLGTFDTAETAARAYDQAAVLMNGQSAKTNFPVIKSNGSNSLEINSALRSPKSLSELLNAKLRKNCKDQTPYLTCLRLDNDSSHIGVWQKRAGSKTSPNWVKLVELGDKVNARPGGDIETNKMKVRNEDVQEDDQMAMQMIEELLNWTCPGSGSIAQV

SEQ ID NO: 2107 - DNA, 1164 bp, Arabidopsis thaliana
  G1425  Predicted polypeptide sequence is paralogous to G504
actctctcaaaccataaaaaatattctccgatcatcattttaatggagagtacagattcttccggtggtcctccgccgccgcaaccaaacctccctccaggattccggtttcatccaacagacgaagaacttgtaattcattacctcaaacgcaaagcagattctgttcctttaccagtcgcgatcatcgccgacgttgatctttacaaatttgatccatgggaacttcccgcgaaagcttcgtttggagaacaagaatggtattttttcagtccaagagatcggaaatatcccaacggagctagacctaaccgagctgcgacttccggttattggaaagcgactggtacagataaaccggtgatttcaaccggcggtggtggtagtaaaaaagtgggagttaaaaaggctctagtgttttacagtggtaaaccaccaaaaggagttaaatcagattggattatgcatgaatatcggttaactgataataaacctactcacatttgtgacttcggcaacaagaaaaactctctcaggcttgatgattgggtgttgtgtcgtatctacaagaaaaacaatagtacagcatctagacatcatcatcatcttcatcatattcatctagataatgatcatcatcgtcatgatatgatgattgatgatgatcgattccgtcatgttcctcctggtcttcacttcccggcgattttttctgacaataatgatccgacggctatatatgatggtggcggcggcggatacggaggtggaagttactcgatgaatcattgtttcgcatctggatcaaagcaggagcagttgtttccaccggtgatgatgatgactagtctaaatcaagattccggtattggatcgtcgtcgtcacctagcaagagatttaacggcggcggcgttggagattgttcgacttctatggcggcgacgccgttaatgcagaaccaaggtgggatttaccaattgcctggtttgaattggtattcttgaaaacaatttacgatgaagaatttttaaaatttgtgtatatatatacggtttgagtgattagggggcattgggggatttatttacggttgattattattgtagtgttatagaactaaggagattaaattaaatagattggaggaaaaaaaaaaaaaaaaa

SEQ ID NO: 2108 - protein, 320 aa, Arabidopsis thaliana
  G1425  Paralogous to G504
MESTDSSGGPPPPQPNLPPGFRFHPTDEELVIHYLKRKADSVPLPVAIIADVDLYKFDPWELPAKASFGEQEWYFFSPRDRKYPNGARPNRAATSGYWKATGTDKPVISTGGGGSKKVGVKKALVFYSGKPPKGVKSDWIMHEYRLTDNKPTHICDFGNKKNSLRLDDWVLCRIYKKNNSTASRHHHHLHHIHLDNDHHRHDMMIDDDRFRHVPPGLHFPAIFSDNNDPTAIYDGGGGGYGGGSYSMNHCFASGSKQEQLFPPVMMMTSLNQDSGIGSSSSPSKRFNGGGVGDCSTSMAATPLMQNQGGIYQLPGLNWYS

SEQ ID NO: 2109 - DNA, 1319 bp, Arabidopsis thaliana
  G1454  Predicted polypeptide sequence is paralogous to G504
ctagtagtgatgatatgatcgcttcttctcctacaatctcagaaacctccgatcacggttttagatatcttctacaacggatacaatggagagcaccgattcttccggtggtccaccaccgccacaacctaaccttcctccaggcttccggtttcaccctaccgacgaagagcttgttgttcactacctcaaacgcaaagcagcctctgctcctttacctgtcgccatcatcgccgaagtcgatctctataaatttgatccatgggaacttcccgctaaagcatcgtttggagaacaagaatggtacttctttagtccacgagatcggaagtatccaaacggagcaagaccaaacagagcggcgacttcaggttattggaaagcgaccggtacagataaaccggtacttgcttccgacggtaaccaaaaggtgggcgtgaagaaggcactagtcttctacagtggtaaaccaccaaaaggcgttaaaagtgattggatcatgcatgagtatcgtctcatcgaaaacaaaccaaacaatcgacctcctggctgtgatttcggcaacaaaaaaaactcactcagacttgatgattgggtgttatgtagaatctacaagaagaacaacgcaagtcgacatgttgataacgataaggatcatgatatgatcgattacattttcaggaagattcctccgtctttatcaatggcggctgcttctacaggacttcaccaacatcatcataatgtctcaagatcaatgaatttcttccctggcaaattctccggtggtggttacgggattttctctgacggtggtaacacgagtatatacgacggcggtggcatgatcaacaatattggtactgactcagtagatcacgacaataacgctgacgtcgttggtttaaatcatgcttcgtcgtcaggtcctatgatgatggcgaatttgaaacgaactctcccggtgccgtattggcctgtagcagatgaggagcaagatgcatctccgagcaaacggtttcacggtgtaggaggaggaggaggagattgttcgaacatgtcttcctccatgatggaagagactccaccattgatgcaacaacaaggtggtgtgttaggagatggattattcagaacgacatcgtaccaattacccggtttaaattggtactcttcttaatcaaatgtgtttcgccgccggtgtgaagaattttccggtgacagtgaagatttttttccgattggtggggtcatttgcatgcattatataatttgagatttgtgtatatgttttgggttaattaattggtcacaggggc

SEQ ID NO: 2110 - protein, 364 aa, Arabidopsis thaliana
  G1454  Paralogous to G504
MESTDSSGGPPPPQPNLPPGFRFHPTDEELVVHYLKRKAASAPLPVAIIAEVDLYKFDPWELPAKASFGEQEWYFFSPRDRKYPNGARPNRAATSGYWKATGTDKPVLASDGNQKVGVKKALVFYSGKPPKGVKSDWIMHEYRLIENKPNNRPPGCDFGNKKNSLRLDDWVLCRIYKKNNASRHVDNDKDHDMIDYIFRKIPPSLSMAAASTGLHQHHHNVSRSMNFFPGKFSGGGYGIFSDGGNTSIYDGGGMINNIGTDSVDHDNNADVVGLNHASSSGPMMMANLKRTLPVPYWPVADEEQDASPSKRFHGVGGGGGDCSNMSSSMMEETPPLMQQQGGVLGDGLFRTTSYQLPGLNWYSS

SEQ ID NO: 2111 - DNA, 1848 bp, Arabidopsis thaliana
  G1456  Predicted polypeptide sequence is paralogous to G1927
tttttttttgtgataacgagagagaaaaaagtgatggacttgtcggttgagaacggaggtttagctccaggttttaggtttcatccgacggacgaagaacttgtcgtctattatctcaaaagaaagatccgtcggaaaaaactcagagtcgaagcaatcggcgagactgatgtctataagtttgatcctgaggaattacctgagaaagcgttgtataagactagagatcgtcaatggttctttttcagcttaagggataggaaacatggaagtaggtcaagtagagctactgaacgtggctattggaaagcaacagggaaggatagagtcattcattgtgattcgagacccgttggagagaagaagactcttgttttccatagaggcagggcacctaatggcgaacggactaattgggtgatgcatgagtatacattgcacaaagaggagctcaagaggtgtggtggtgaagatgttaaggatgcttatgttctttacaagatttataagaaaagtgggtctggtcctaagaatggtgagcaatatggagctccttttattgaagaagaatgggctgaagatgatgatgatgatgttgatgagcctgctaatcagctcgttgtttcggctagtgttgataatagtttatgggggaaagggcttaaccaatctgaattggatgataatgatattgaagagctgatgagtcaggttagagatcagtctggtccaacattgcagcagaatggggtgtctggactgaactctcatgtagacacgtataatctggagaacctggaggaagatatgtatttggaaatcaatgatcttatggaacctgaacctgaaccaacttctgtggaagtcatggagaataactggaacgaggatggttctggtctcctgaatgatgatgatttcgttggtgctgattcatatttccttgatttgggagtgacaaatcctcagttagattttgttagtggtgatttgaaaaatgggtttgcacaaagtcttcaggtgaatacttctttaatgacttaccaggccaataataaccagttccagcagcaatcagggaagaaccaagctagtaactggccactccgtaacagctataccagacagataaacaatggatcatcgtgggtgcaggagctaaacaatgacggacttaccgttacccggtttggtgaggcgcctggtacaggtgattcatctgaattcctaaaccctgttccttctggtataagtacaactaatgaagatgacccgtcaaaagacgagtctagtaagtttgcttctagtgtatggactttcctggaatccattcctgcaaagccagcatatgcatcagagaatccatttgtgaagctgaaccttgttagaatgtcaaccagtggtggtcgtttcaggtttacttctaaaagcacaggtaataatgttgttgttatggatagtgactcagcagtgaagaggaacaagtctggaggaaacaacgataagaagaagaagaagaacaaaggtttcttttgcttatcgatcattggggctttatgtgctttgttttgggtgatcataggaacaatgggaggttcagggaggcctttgttatggtgagaaccgaaaaatccaagaggttaagagacataaaggcttggttttgtgtgaaccattagagagtcaagtcattgtaattattctcttggattattagattcagaagctgtttagtatcacagtttatgcttggaagttttctctggtattggtaaaaaagtaccaatagaaataagcaaaagaattttcttatcttttaaaaaaaaaaaaaaaaaaaaaaaaaaaaaa

SEQ ID NO: 2112 - protein, 528 aa, Arabidopsis thaliana
  G1456  Paralogous to G1927
MDLSVENGGLAPGFRFHPTDEELVVYYLKRKIRRKKLRVEAIGETDVYKFDPEELPEKALYKTRDRQWFFFSLRDRKHGSRSSRATERGYWKATGKDRVIHCDSRPVGEKKTLVFHRGRAPNGERTNWVMHEYTLHKEELKRCGGEDVKDAYVLYKIYKKSGSGPKNGEQYGAPFIEEEWAEDDDDDVDEPANQLVVSASVDNSLWGKGLNQSELDDNDIEELMSQVRDQSGPTLQQNGVSGLNSHVDTYNLENLEEDMYLEINDLMEPEPEPTSVEVMENNWNEDGSGLLNDDDFVGADSYFLDLGVTNPQLDFVSGDLKNGFAQSLQVNTSLMTYQANNNQFQQQSGKNQASNWPLRNSYTRQINNGSSWVQELNNDGLTVTRFGEAPGTGDSSEFLNPVPSGISTTNEDDPSKDESSKFASSVWTFLESIPAKPAYASENPFVKLNLVRMSTSGGRFRFTSKSTGNNVVVMDSDSAVKRNKSGGNNDKKKKKNKGFFCLSIIGALCALFWVIIGTMGGSGRPLLW

SEQ ID NO: 2113 - DNA, 1392 bp, Arabidopsis thaliana
  G1461  Predicted polypeptide sequence is paralogous to G1463
accgcccgcccgggcaggttaaacagtgaaaaaatatccgtggaagaagggtagttgagaaataaaaagagatcaacaagggtaaattaatcaatacgaaacttagatataacggttgccattaacttaaaagcacatttatgaacatgagtcttcttcgcttcatctccaagaaacaacactcatttttgcgtttaatctttctctctctcttgatcgatttagtttctttatgaggacgaaccaatgaaagttgaagacgaagcaacttatgagcttatcaaagacgaactgatgaaagcagaagacgaagcaacttattggctaatcaaagaagaactgatcaaagcagaagacgatgtaatcatctcacgttatctgaagcgtatgatcgttaacggggattcgtggcctgatcacttcatcgaagatgtagacgtgttcaacaagaatccaaatgaggagtttcattctcagagccctagattcgtgatcgttaaaccacgaacagagaattgtggtagaaccgatggatgtcaatctggttgctggaggatcattggtcgtgataaactgataaaatcgaaggagactgggaagattctagggttcaagaagattctcaagttctgcctaaagaagaaacctagagaatacaagagaagttgggtaatggaagagtacaggcttaacaataacttgaactgcaagcaagatcatgtgatttgcaagattcggtttatgttcgatgctgaaatcagtttcttgctagccaagcatttctcgtgtctctccactagatcaccgcttcctgcaaatcaattgttgccagcttatggagtctgtttcttcgattcagaagcggagggtgcattttatctggagacgataatcggttatgatggaaacacttggcctagctacgttaccaacgatgtgtaccgtttgcatccgttgacgcttgtggatcctcaagatgacaagtttaaagagttcggaacctgtatctttgctaacaggacaaagacttgtggtaaaaccgatgaatgtgatggtggtggttgctggaggatcgtagaaggtcatagagttatcaagtcaaaaggtaaggttcttggttacaggaggatttttcaattttcggaaaatgaggaaccaagaaatgtttgtgaaggagaagatccgaagaaaactgcttggttcatagaagagtataggcctgacgaaaataataagaaggataaagtgttatgcgttatcaagttcttaatcccactcaaccaaaggtaacaaggagattttactctggaagtcatactccgtagcacttcgatgtgttcttactgagactggtcacattagctgatagggtatatcaaaaaaaaaaaaaaa

SEQ ID NO: 2114 - protein, 347 aa, Arabidopsis thaliana
  G1461  Paralogous to G1463
MKVEDEATYELIKDELMKAEDEATYWLIKEELIKAEDDVIISRYLKRMIVNGDSWPDHFIEDVDVFNKNPNEEFHSQSPRFVIVKPRTENCGRTDGCQSGCWRIIGRDKLIKSKETGKILGFKKILKFCLKKKPREYKRSWVMEEYRLNNNLNCKQDHVICKIRFMFDAEISFLLAKHFSCLSTRSPLPANQLLPAYGVCFFDSEAEGAFYLETIIGYDGNTWPSYVTNDVYRLHPLTLVDPQDDKFKEFGTCIFANRTKTCGKTDECDGGGCWRIVEGHRVIKSKGKVLGYRRIFQFSENEEPRNVCEGEDPKKTAWFIEEYRPDENNKKDKVLCVIKFLIPLNQR

SEQ ID NO: 2115 - DNA, 1127 bp, Arabidopsis thaliana
  G1462  Predicted polypeptide sequence is paralogous to G1463
cgtcgaccattcttgcgattgatctttctctagataatttttttgatcgatttagtttcattatggaggacgacgacgcagcttatgatctaatcaaacacgaactgttatactcagaagacgaagtaataatctcacgttatctgaagggtatggtcgttaacggagattcttggccagatcacttcatcgaagacgcaaacgtgttcaccaagaatccagataaggtgttcaattctgagagacctagattcgtgatcgttaaaccacgaacagaggcttgtggtaaaaccgatggatgtgattcgggttgctggaggatcattggtcgtgataaactgataaagtcggaggagactgggaagattctagggttcaagaagatactcaagttttgcctaaagaggaaacctatagactacaagagaagttgggtaatggaagagtataggcttaccaataacttgaactggaagcaagatcatgtgatttgcaaaattcggtttatgtttgaagctgaaattagtttcttgctaagcaagcatttctacactacatcagaatcggttcttgaaaatgagctgttgccatcttatggatattatttatccaatacacaagaggaggatgaattttatctggacgcgataatgacttcggaaggaaacgagtggcctagctacgttaccaacaacgtgtactgtctgcatccattggagcttgtggatcttcaagatcggatgtttaatgattacggaacctgcatcttcgctaacaagacttgtggtgaaactgataaatgcgatggtggttactggaagatcctgcacggtgataagctgatcaagtcaaatttcggaaaggtcattggtttcaagaaggtatttgagttctatgaaacggtgagacaaatatatctttgtgatggagaagaagtgacggtaacttggactatacaagagtataggcttagcaaaaacgtgaagcagaataaagtgttgtgcgttatcaagttgacttatgatagataggatactttactttggtttttgtgatcatcttagtatcttacgaatattctagatacacacatctataggcgaccgctctagacaggcctcgtaccg

SEQ ID NO: 2116 - protein, 322 aa, Arabidopsis thaliana
  G1462  Paralogous to G1463
MEDDDAAYDLIKHELLYSEDEVIISRYLKGMVVNGDSWPDHFIEDANVFTKNPDKVFNSERPRFVIVKPRTEACGKTDGCDSGCWRIIGRDKLIKSEETGKILGFKKILKFCLKRKPIDYKRSWVMEEYRLTNNLNWKQDHVICKIRFMFEAEISFLLSKHFYTTSESVLENELLPSYGYYLSNTQEEDEFYLDAIMTSEGNEWPSYVTNNVYCLHPLELVDLQDRMFNDYGTCIFANKTCGETDKCDGGYWKILHGDKLIKSNFGKVIGFKKVFEFYETVRQIYLCDGEEVTVTWTIQEYRLSKNVKQNKVLCVIKLTYDR

SEQ ID NO: 2117 - DNA, 1195 bp, Arabidopsis thaliana
  G1464  Predicted polypeptide sequence is paralogous to G1463
ccatgagtctcacttcttcttcgctctccaagaaacaaaacactcgatcttgcgtttgatctttctctctctatagatctttttcttgatcgattttatctcattatggaagataacgacgcagcttatgatcaagtcaaatccgaactgttaaactcagaagacgaagtaataatctcacgttatctgaagcctatggtcgttaacggagattcttggccagatcacttcatcgaagacgcaaacgtgttcaccaagaatccaaatgaggtgttcaattctgagagacctagattcgttatcgttaaaccacgaacagaggcttgtggtaagaccgatggatgtgaatctggttgctggaggaccatgggtcgtgataaactgataaagtcggaggagactgggaagattctagggttcaagaagattctcaagttttgcataaagtggaaacctatagaatacaagagaagttgggtaatggaagagtataggcttaccaataacttgaactggaagcaagatcatgtgatttgcaagattcggcttttgtttgaagcagaaattagtttcttgctagccaagcatttctacactacgtcagaatcacttcttcgacatgagctattgccatcttatggatatttatccaatacacaagaggaggatgaattttatctgaagacgataatgacttcggaaggaaacgattggcctagctacgttaccaacaacgtgtactgtcttcatccattggagcttgtggatcttcaagatgtgatgtttcaaagttacggaacctgcatcttcgctaacgggacttgtggtgaatctgataaatgcgatggtggttactggaagatcctgcacggtgataagctgatcaagtcaaatttcgggatggtcactggtttcaagaaggaagaaacagagaggttaggtcatcaacgttgccaaggcttgttgttgccacaccgtcgtggccatgtacaaaccaagagttgcggtgtcgtcaccgtgaaggagaagaggagtttggtagagcaaccggaggagattgtcgctgcacctgagacaccacgccaaggaaaaagtgagcataatgatccactaaagcgaaagaaagcgattggttgcgtgggagagaaagctgagatgtaggcgagacgtcaccactacgaatggagatgcggcc

SEQ ID NO: 2118 - protein, 351 aa, Arabidopsis thaliana
  G1464  Paralogous to G1463
MEDNDAAYDQVKSELLNSEDEVIISRYLKPMVVNGDSWPDHFIEDANVFTKNPNEVFNSERPRFVIVKPRTEACGKTDGCESGCWRTMGRDKLIKSEETGKILGFKKILKFCIKWKPIEYKRSWVMEEYRLTNNLNWKQDHVICKIRLLFEAEISFLLAKHFYTTSESLLRHELLPSYGYLSNTQEEDEFYLKTIMTSEGNDWPSYVTNNVYCLHPLELVDLQDVMFQSYGTCIFANGTCGESDKCDGGYWKILHGDKLIKSNFGMVTGFKKEETERLGHQRCQGLLLPHRRGHVQTKSCGVVTVKEKRSLVEQPEEIVAAPETPRQGKSEHNDPLKRKKAIGCVGEKAEM

SEQ ID NO: 2119 - DNA, 1236 bp, Arabidopsis thaliana
  G1465  Predicted polypeptide sequence is paralogous to G1463
tatccttcgcaagacccttcctctatataaggaagttcatttcatttggagaggacacgctgacaagctgactctagcttatctggtaccgtcgacctcattcttgcgtttgatctttctttctctagatcccatatttttcttgatcaatttagtttcattatggaggaagatgcagcttttgatctactcaaagccgaactcttaaacgcagaagacgatgcaataatctcacgttatctgaagcgtatggtcgtcaacggagactcatggcctgatcacttcatcgaagacgcagacgtgttcaacaagaatccaaatgtggagttcgatgctgagagccctagcttcgtgatagttaaacctcgaacagaggcttgtggtaaaaccgatggatgtgaaactggttgctggaggatcatgggtcgtgataaaccgataaaatcgacggagactgtgaagattcaagggttcaagaagattctcaagttctgcctaaagaggaaacctagaggatacaagagaagttgggtaatggaagagtataggcttaccaataacttgaactggaagcaagatcatgtgatttgcaagattcggtttatgtttgaagctgaaatcagtttcttgctagccaagcatttctacactacatcagaatcacttcctcgaaatgagctgttgccagcttacggattcctttcatcagataagcaattggaggatgtatcttatccggtgacgataatgacttctgaaggaaacgattggcctagctacgttaccaacaatgtgtattgtctgcatccattggagctcgttgatcttcaagatcggatgtttaatgattacggaacctgcatcttcgctaacaagacttgtggtaaaaccgatagatgcattaatggtggttactggaaaattttgcaccgtgataggctgatcaagtcaaagtccgggatagttattggtttcaagaaggtgtttaagtttcatgaaacggagaaagaaagatacttctgtggtggagaagatgtgaaggtaacttggactctagaagagtataggcttagcgtgaagcagaataaattcttgtgcgttatcaagtttacttatgataactaagaatcttttctttggattttatgatcatcttagtatcgcgaccgctctagacaggcctcgtaccggatcctctagctagagctttcgttcgtatcatcggtttcgacaacg

SEQ ID NO: 2120 - protein, 320 aa, Arabidopsis thaliana
  G1465  Paralogous to G1463
MEEDAAFDLLKAELLNAEDDAIISRYLKRMVVNGDSWPDHFIEDADVFNKNPNVEFDAESPSFVIVKPRTEACGKTDGCETGCWRIMGRDKPIKSTETVKIQGFKKILKFCLKRKPRGYKRSWVMEEYRLTNNLNWKQDHVICKIRFMFEAEISFLLAKHFYTTSESLPRNELLPAYGFLSSDKQLEDVSYPVTIMTSEGNDWPSYVTNNVYCLHPLELVDLQDRMFNDYGTCIFANKTCGKTDRCINGGYWKILHRDRLIKSKSGIVIGFKKVFKFHETEKERYFCGGEDVKVTWTLEEYRLSVKQNKFLCVIKFTYDN

SEQ ID NO: 2121 - DNA, 1218 bp, Arabidopsis thaliana
  G1484  Predicted polypeptide sequence is paralogous to G1255
atgaaaagtttggctagtgcggttggagggaagacggcgagggcatgtgatagctgcgtgaagaggcgggcacgttggtattgcgcagctgatgatgcctttctttgccatgcttgtgacggttcggtccactcggcaaaccctcttgctcgtaggcacgagagagttcgcttgaaatcggctagcgccggaaagtatcgccatgcctcgccgcctcaccaagccacgtggcatcagggatttacacgtaaagctcggaccccacgtggaggcaagaagagccacacgatggtttttcatgatcttgtgccggagatgagcacggaggatcaagcggagagttacgaggtggaagagcagctcatatttgaggtgccggtgatgaactcgatggttgaggagcaatgctttaaccaatccctggagaaacagaatgagtttccaatgatgcccttaagtttcaagagtagtgacgaagaagatgacgacaacgctgagagttgtctgaatggtttgttcccaaccgacatggaactagctcagttcacagctgacgtggagactctactcggtggaggggatcgagagtttcattccatagaagaactagggttaggtgagatgttaaagatcgaaaaagaggaggtggaggaagagggagttgtgacaagagaagtgcatgatcaagatgaaggtgatgagacatccccatttgaaataagctttgactacgagtacacacacaagaccacattcgatgaaggagaagaagatgagaaagaagacgtgatgaagaatgtgatggagatgggagtgaatgagatgagtggtgggattaaagaagagaagaaggagaaggctcttatgcttagattggactatgaatcagtcatttccacttggggaggccaagggatcccatggaccgcccgggtgccatctgaaatagacctcgacatggtttgtttcccaacccataccatgggtgaaagtggagcagaggctcatcatcacaaccacttccgcggcctagggttacacctaggagatgctggggatggaggaagagaggctagggtttcaagataccgagagaaaaggaggacaaggttgttctccaagaagataaggtacgaggtacgtaaattgaatgcagagaaaaggcctcgcatgaaaggaaggttcgtcaagagatcttcaattggtgttgctcactaa

SEQ ID NO: 2122 - protein, 405 aa, Arabidopsis thaliana
  G1484  Paralogous to G1255
MKSLASAVGGKTARACDSCVKRRARWYCAADDAFLCHACDGSVHSANPLARRHERVRLKSASAGKYRHASPPHQATWHQGFTRKARTPRGGKKSHTMVFHDLVPEMSTEDQAESYEVEEQLIFEVPVMNSMVEEQCFNQSLEKQNEFPMMPLSFKSSDEEDDDNAESCLNGLFPTDMELAQFTADVETLLGGGDREFHSIEELGLGEMLKIEKEEVEEEGVVTREVHDQDEGDETSPFEISFDYEYTHKTTFDEGEEDEKEDVMKNVMEMGVNEMSGGIKEEKKEKALMLRLDYESVISTWGGQGIPWTARVPSEIDLDMVCFPTHTMGESGAEAHHHNHFRGLGLHLGDAGDGGREARVSRYREKRRTRLFSKKIRYEVRKLNAEKRPRMKGRFVKRSSIGVAH

SEQ ID NO: 2123 - DNA, 2511 bp, Arabidopsis thaliana
  G1548  Predicted polypeptide sequence is paralogous to G390, G391, G438
atggcaatgtcttgcaaggatggtaagttgggatgtttggataatgggaagtatgtgaggtatacacctgaacaagttgaagcacttgagaggctttatcatgactgtcctaaaccgagttctattcgccgtcagcagttgatcagagagtgtcctattctctctaacattgagcctaaacagatcaaagtgtggtttcagaaccgaagatgtagagagaaacaaaggaaagaggcttcacggcttcaagctgtgaatcggaagttgacggcaatgaacaagctcttgatggaggagaatgacaggttgcagaagcaagtgtcacagctggtccatgaaaacagctacttccgtcaacatactccaaatccttcactcccagctaaagacacaagctgtgaatcggtggtgacgagtggtcagcaccaattggcatctcaaaatcctcagagagatgctagtcctgcaggacttttgtccattgcagaagaaactttagcagagtttctttcaaaggcaactggaaccgctgttgagtgggttcagatgcctggaatgaagcctggtccggattccattggaatcatcgctatttctcatggttgcactggtgtggcagcacgcgcctgtggcctagtgggtcttgagcctacaagggttgcagagattgtcaaggatcgtccttcgtggttccgcgaatgtcgagctgttgaagttatgaacgtgttgccaactgccaatggtggaaccgttgagctgctttatatgcagctctatgcaccaactacattggccccaccacgcgatttctggctgttacgttacacctctgttttagaagatggcagccttgtggtgtgcgagagatctcttaagagcactcaaaatggtcctagtatgccactggttcagaattttgtgagagcagagatgctttccagtgggtacttgatacggccttgtgatggtggtggctcaatcatacacatagtggatcatatggatttggaggcttgtagcgtgcctgaggtcttgcgcccgctctatgagtcacccaaagtacttgcacagaagacaacaatggcggcactgcgtcagctcaagcaaatagctcaggaggttactcagactaatagtagtgttaatgggtggggacggcgtcctgctgccttaagagctctcagccagaggctaagcagaggcttcaatgaagctgtaaatggtttcactgatgaaggatggtcagtgataggagatagcatggatgatgtcacaatcactgtaaactcttctccagacaagctaatgggtctaaatcttacatttgccaatggctttgctcctgtaagcaatgttgttttatgcgcaaaagcatcaatgcttttacagaatgttcctccggcgatcctgcttcggtttctgagggagcataggtcagaatgggctgacaacaacattgatgcgtatctagcagcagcagttaaagtagggccttgtagtgcccgagttggaggatttggagggcaggttatacttccacttgctcatactattgagcatgaagagtttatggaagtcatcaaattggaaggtcttggtcattcccctgaagatgcaatcgttccaagagatatcttccttcttcaactttgtagcggaatggatgaaaatgctgtaggaacctgtgcggaacttatatttgctccaatcgatgcttcgtttgcggatgatgcacctctgcttccttctggttttcgtattatccctcttgattccgcaaaggaagtatctagcccaaaccgaaccttggatcttgcttcggcactggaaattggttcagctggaacaaaagcctcaactgatcaatcaggaaactccacatgtgcaagatctgtgatgacaatagcatttgagtttggtatcgagagccatatgcaagaacatgtagcatccatggctaggcagtatgttcgaggtatcatatcatcggtgcagagagtagcattggctctttctccttctcatatcagctcacaagttggtctacgcactcctttgggtactcctgaagcccaaacacttgctcgttggatttgccagagttacaggggctacatgggtgttgagctacttaaatcaaacagtgacggcaatgaatctattcttaagaatctttggcatcacactgatgctataatctgctgctcaatgaaggccttgcccgtcttcacatttgcaaaccaggcgggacttgacatgctggagactacattagttgctcttcaagacatctctttagagaagatatttgatgacaatggaagaaagactctttgctctgagttcccacagatcatgcaacagggcttcgcgtgccttcaaggcgggatatgtctctcaagcatggggagaccagtttcgtatgagagagcagttgcttggaaagtactcaatgaagaagaaaatgctcattgcatctgctttgtgttcatcaattggtcctttgtgtga

SEQ ID NO: 2124 - protein, 836 aa, Arabidopsis thaliana
  G1548  Paralogous to G390, G391, G438
MAMSCKDGKLGCLDNGKYVRYTPEQVEALERLYHDCPKPSSIRRQQLIRECPILSNIEPKQIKVWFQNRRCREKQRKEASRLQAVNRKLTAMNKLLMEENDRLQKQVSQLVHENSYFRQHTPNPSLPAKDTSCESVVTSGQHQLASQNPQRDASPAGLLSIAEETLAEFLSKATGTAVEWVQMPGMKPGPDSIGIIAISHGCTGVAARACGLVGLEPTRVAEIVKDRPSWFRECRAVEVMNVLPTANGGTVELLYMQLYAPTTLAPPRDFWLLRYTSVLEDGSLVVCERSLKSTQNGPSMPLVQNFVRAEMLSSGYLIRPCDGGGSIIHIVDHMDLEACSVPEVLRPLYESPKVLAQKTTMAALRQLKQIAQEVTQTNSSVNGWGRRPAALRALSQRLSRGFNEAVNGFTDEGWSVIGDSMDDVTITVNSSPDKLMGLNLTFANGFAPVSNVVLCAKASMLLQNVPPAILLRFLREHRSEWADNNIDAYLAAAVKVGPCSARVGGFGGQVILPLAHTIEHEEFMEVIKLEGLGHSPEDAIVPRDIFLLQLCSGMDENAVGTCAELIFAPIDASFADDAPLLPSGFRIIPLDSAKEVSSPNRTLDLASALEIGSAGTKASTDQSGNSTCARSVMTIAFEFGIESHMQEHVASMARQYVRGIISSVQRVALALSPSHISSQVGLRTPLGTPEAQTLARWICQSYRGYMGVELLKSNSDGNESILKNLWHHTDAIICCSMKALPVFTFANQAGLDMLETTLVALQDISLEKIFDDNGRKTLCSEFPQIMQQGFACLQGGICLSSMGRPVSYERAVAWKVLNEEENAHCICFVFINWSFV

SEQ ID NO: 2125 - DNA, 800 bp, Arabidopsis thaliana; identical to SEQ ID NO: 313
  G1646  Predicted polypeptide sequence is paralogous to G715

SEQ ID NO: 2126 - protein, 250 aa, Arabidopsis thaliana; identical to SEQ ID NO: 314
  G1646  Paralogous to G715

SEQ ID NO: 2127 - DNA, 1564 bp, Arabidopsis thaliana
  G1664  Predicted polypeptide sequence is paralogous to G1062
ctctctctctctctctactagtttgacatgaacagcgacggtgtttggcttgacggctccggtgaatctccggaagttaataacggtgaagctgcgtcttgggtcagaaacccagatgaagactggttcaataacccaccaccaccacaacacactaatcaaaacgacttcagattcaatggtggctttcctttaaacccctcagagaatctgcttcttcttcttcagcaatcgattgattcttcttcttcttcttctccgttattacatcctttcacactcgacgctgcttcacagcaacaacaacaacaacaacaacaacaggaacagtctttcttagctacgaaagcttgtatagtttctcttctcaacgtcccaaccatcaataacaacactttcgatgacttcggctttgactctggtttcttaggacaacaattccatggaaatcatcaatctccgaactcgatgaatttcactggcttaaaccactcagtaccggattttcttccagctccggaaaacagctcaggatcatgtggattgagtcctctgttctcaaacagagcaaaggttttaaaaccgttacaggtaatggcttcatctggctcgcagccaactctgtttcagaaacgagctgcaatgcgtcagagctcgagtagcaaaatgtgcaattctgagagttcttctgaaatgaggaaatcgagctacgagagagagattgacgatactagtaccggaatcatcgatatctctggattgaattacgaatctgatgaccataatactaataacaacaaaggtaagaagaaaggaatgcctgcaaagaatcttatggctgagagaagaagaaggaagaagcttaatgataggctttacatgcttagatcagttgttcccaagatcagcaaaatggatagagcatcaatacttggagatgctattgattacctcaaagagcttttacaaagaatcaacgatcttcacaccgaacttgaatctactccaccgagttcttcaagcttgcatccgttaacaccgactccacaaacgctgtcttaccgtgttaaggaagagttgtgtccatcttcctccttgccaagtcctaaaggccaacaaccaagagttgaggttagattaagagaaggaaaggcagtgaacatacacatgttctgtggacgtagaccaggtcttttactttccaccatgagagctttggataacttaggattggatgttcaacaagcggtgattagctgtttcaatggttttgctttggatgttttccgcgctgagcaatgtcaagaagaccatgacgtgttacctgaacaaatcaaagcagtgcttttagatacagcaggttacgctggtttggtttgattgcgaagcagaaggaagcatctgtgtggaacagagctagatctaagtccttgttctgttttagtcagcaattttcttacttagtttcatcaatttcaatcatgtatggaagatgataactgttttattttagctatgagaacatgtgtttggggaacaatagttgcaacctttgagcaaaaaa

SEQ ID NO: 2128 - protein, 450 aa, Arabidopsis thaliana
  G1664  Paralogous to G1062
MNSDGVWLDGSGESPEVNNGEAASWVRNPDEDWFNNPPPPQHTNQNDFRFNGGFPLNPSENLLLLLQQSIDSSSSSSPLLHPFTLDAASQQQQQQQQQQEQSFLATKACIVSLLNVPTINNNTFDDFGFDSGFLGQQFHGNHQSPNSMNFTGLNHSVPDFLPAPENSSGSCGLSPLFSNRAKVLKPLQVMASSGSQPTLFQKRAAMRQSSSSKMCNSESSSEMRKSSYEREIDDTSTGIIDISGLNYESDDHNTNNNKGKKKGMPAKNLMAERRRRKKLNDRLYMLRSVVPKISKMDRASILGDAIDYLKELLQRINDLHTELESTPPSSSSLHPLTPTPQTLSYRVKEELCPSSSLPSPKGQQPRVEVRLREGKAVNIHMFCGRRPGLLLSTMRALDNLGLDVQQAVISCFNGFALDVFRAEQCQEDHDVLPEQIKAVLLDTAGYAGLV

SEQ ID NO: 2129 - DNA, 943 bp, Arabidopsis thaliana
  G1759  Predicted polypeptide sequence is paralogous to G157, G859, G1842, G1843
cgagaaaaggaaaaaaaaaaatagaaagagaaaacgcttagtatctccggcgacttgaacccaaacctgaggatcaaattagggcacaaagccctctcggagagaagccatgggaagaaaaaaactagaaatcaagcgaattgagaacaaaagtagccgacaagtcaccttctccaaacgtcgcaacggtctcatcgagaaagctcgtcagctttctgttctctgtgacgcatccgtcgctcttctcgtcgtctccgcctccggcaagctctacagcttctcctccggcgataacctggtcaagatccttgatcgatatgggaaacagcatgctgatgatcttaaagccttggatcatcagtcaaaagctctgaactatggttcacactatgagctacttgaacttgtggatagcaagcttgtgggatcaaatgtcaaaaatgtgagtatcgatgctcttgttcaactggaggaacaccttgagactgccctctccgtgactagagccaagaagaccgaactcatgttgaagcttgttgagaatcttaaagaaaaggagaaaatgctgaaagaagagaaccaggttttggctagccagatggagaataatcatcatgtgggagcagaagctgagatggagatgtcacctgctggacaaatctccgacaatcttccggtgactctcccactacttaattagccaccttaaatcggcggttgaaatcaaaatccaaaacatatataattatgaagaaaaaaaaaataagatatgtaattattccgctgataagggcgagcgtttgtatatcttaatactctctctttggccaagagactttgtgtgtgatacttaagtagacggaactaagtcaatactatctgttttaagacaaaaggttgatgaactttgtaccttattcgtgtgagaaaaaaaaaaaaaaaa

SEQ ID NO: 2130 - protein, 196 aa, Arabidopsis thaliana
  G1759  Paralogous to G157, G859, G1842, G1843
MGRKKLEIKRIENKSSRQVTFSKRRNGLIEKARQLSVLCDASVALLVVSASGKLYSFSSGDNLVKILDRYGKQHADDLKALDHQSKALNYGSHYELLELVDSKLVGSNVKNVSIDALVQLEEHLETALSVTRAKKTELMLKLVENLKEKEKMLKEENQVLASQMENNHHVGAEAEMEMSPAGQISDNLPVTLPLLN

SEQ ID NO: 2131 - DNA, 927 bp, Arabidopsis thaliana
  G1782  Predicted polypeptide sequence is paralogous to G1363
atgcaagtgtttcaaaggaaagaagattcatcttggggaaactcaatgcctacaacaaattcaaatattcaaggatctgaatctttcagcttgactaaggatatgataatgtctacaacacaattacccgcgatgaaacattcgggtttgcagctgcaaaatcaagattcaacctcatcacaatctactgaagaagaatcaggcggcggtgaagttgcaagctttggagaatataagcgttatggatgcagcattgttaataacaatctctcaggttacatcgaaaacttgggaaagcctattgaaaattatactaagtcaattactacctcgtcgatggtgtctcaagactctgtgtttcctgctcctacttctggtcaaatatcttggtctcttcaatgtgctgaaacgtcacatttcaatggtttcttggctcctgaatatgcatcaacaccaacggcgctgccacatttagagatgatgggtttggtttcttcaagagtgccattgcctcatcacattcaagagaatgaaccaatatttgtcaatgcgaaacagtatcatgcgattctccgtcgcaggaagcaccgtgctaaactcgaagctcagaacaaactcatcaaatgccgtaaaccgtaccttcatgagtctcgccatcttcatgctttaaagagagctagaggctccggtggacgtttcctcaatacaaagaagcttcaagaatcatcaaactcactgtgttcttctcaaatggcaaatggacaaaatttctctatgagccctcacggtggtggaagcggaatcgggtctagttcgatctcaccgagctccaattcaaactgtatcaacatgttccaaaacccgcagttcagattctcaggttatccgtcaacacaccatgcctcagctctcatgtcagggacttga

SEQ ID NO: 2132 - protein, 308 aa, Arabidopsis thaliana
  G1782  Paralogous to G1363
MQVFQRKEDSSWGNSMPTTNSNIQGSESFSLTKDMIMSTTQLPAMKHSGLQLQNQDSTSSQSTEEESGGGEVASFGEYKRYGCSIVNNNLSGYIENLGKPIENYTKSITTSSMVSQDSVFPAPTSGQISWSLQCAETSHFNGFLAPEYASTPTALPHLEMMGLVSSRVPLPHHIQENEPIFVNAKQYHAILRRRKHRAKLEAQNKLIKCRKPYLHESRHLHALKRARGSGGRFLNTKKLQESSNSLCSSQMANGQNFSMSPHGGGSGIGSSSISPSSNSNCINMFQNPQFRFSGYPSTHHASALMSGT

SEQ ID NO: 2133 - DNA, 549 bp, Arabidopsis thaliana
  G1791  Predicted polypeptide sequence is paralogous to G1792
atgtacatgcaaaaacaaaaaccttaaaagctttcatggaacgtatagagtcttataacacgaatgagatgaaatacagaggcgtacgaaagcgtccatggggaaaatatgcggcggagattcgcgactcagctagacacggtgctcgtgtttggcttgggacgtttaacacagcggaagacgcggctcgggcttatgatagagcagctttcggcatgagaggccaaagggccattctcaattttcctcacgagtatcaaatgatgaaggacggtccaaatggcagccacgagaatgcagtggcttcctcgtcgtcgggatatagaggaggaggtggtggtgatgatgggagggaagttattgagttcgagtatttggatgatagtttattggaggagcttttagattatggtgagagatctaaccaagacaattgtaacgacgcaaaccgctagatcatcactacttacttacagtgtaatgtttttggagtaaagagtaataatcaatataatatactttagtttaggaaaaaaaaaaaaaaaaaaa

SEQ ID NO: 2134 - protein, 139 aa, Arabidopsis thaliana
  G1791  Paralogous to G1792
MERIESYNTNEMKYRGVRKRPWGKYAAEIRDSARHGARVWLGTFNTAEDAARAYDRAAFGMRGQRAILNFPHEYQMMKDGPNGSHENAVASSSSGYRGGGGGDDGREVIEFEYLDDSLLEELLDYGERSNQDNCNDANR

SEQ ID NO: 2135 - DNA, 450 bp, Arabidopsis thaliana
  G1795  Predicted polypeptide sequence is paralogous to G1792
acaaacacgcaaaaagtcattaatatatggatcaaggaggtcgaggtgtcggtgccgagcatggaaagtaccggggagttcggagacgaccttggggaaaatatgcagcagagatacgagattcgaggaagcacggtgaacgtgtgtggcttggaacgttcgatacggcagaggaagcggctagagcctatgaccaagctgcttactccatgagaggccaagcagcaatccttaacttccctcatgagtataacatggggagtggtgtctcttcttccaccgccatggctggatcttcctccgcctccgcctccgcttcttcttcttctaggcaagtttttgaatttgagtacttggatgatagtgttttggaggagctccttgaggaaggagagaaacctaacaagggcaagaagaaatgagcgagatataattcatgattatttctaa

SEQ ID NO: 2136 - protein, 131 aa, Arabidopsis thaliana
  G1795  Paralogous to G1792
MDQGGRGVGAEHGKYRGVRRRPWGKYAAEIRDSRKHGERVWLGTFDTAEEAARAYDQAAYSMRGQAAILNFPHEYNMGSGVSSSTAMAGSSSASASASSSSRQVFEFEYLDDSVLEELLEEGEKPNKGKKK

SEQ ID NO: 2137 - DNA, 1356 bp, Arabidopsis thaliana
  G1806  Predicted polypeptide sequence is paralogous to G1198
atgcagagcagcttcaaaaccgttcctttcactcctgatttctactctcaatcctcttacttcttcagaggagatagttgtcttgaggagtttcatcaaccagtcaatggttttcaccatgaagaagctatcgatttaagtccaaatgtcactattgcttcagctaacttacactacacgacgtttgatacggttatggattgtggtggtggtggtggtggcttgagggagagacttgaaggaggagaagaggagtgtttggacacagggcaattagtgtaccagaaagggacaagattagtaggaggaggagtaggagaagtgaacagcagttggtgtgattcggtttcagctatggctgataacagtcaacatactgacacttccacagatattgatactgatgacaagactcagttgaatggaggtcatcaagggatgctattggctacaaattgttcagatcaatccaatgtgaaatctagtgatcaaaggacacttcgtcgacttgctcagaaccgggaggctgctaggaaaagtcggttgaggaaaaaggcctatgttcagcaacttgagaatagtcgaatcaggcttgcacagctagaggaagagctcaaaagagctcgccaacagggatctttggttgaaagaggagtttcagcggatcacacgcatttggcagcaggaaatggtgtcttttcatttgaattggaatatacacgttggaaggaggaacatcaaagaatgatcaacgacttaagatcgggtgtgaattcgcagttaggtgacaacgatctacgcgttctagtggatgctgtgatgagtcactatgatgaaatattcaggctaaagggaattggcactaaagttgaagtctttcatatgctctcaggcatgtggaagacacctgccgagagatttttcatgtggttaggtggatttagatcatcagagttacttaagatattggggaaccatgtggatccattgacggaccagcagttgataggcatttgcaaccttcagcaatcgtctcaacaagcagaggatgcattgtcacaaggcatggaagctctacaacaatcacttctcgagacgctttcttctgcttctatgggtccaaactcttcagcaaatgttgcagattatatgggtcatatggctatggctatgggcaaacttggcactcttgaaaacttccttcgccaggctgatttattgaggcaacaaactctgcaacagcttcacagaattctcaccacacgacaagctgctcgcgcctttttggtcatccacgattatatttctcggcttagagcacttagctctctatggttagccagacctagagactaa

SEQ ID NO: 2138 - protein, 451 aa, Arabidopsis thaliana
  G1806  Paralogous to G1198
MQSSFKTVPFTPDFYSQSSYFFRGDSCLEEFHQPVNGFHHEEAIDLSPNVTIASANLHYTTFDTVMDCGGGGGGLRERLEGGEEECLDTGQLVYQKGTRLVGGGVGEVNSSWCDSVSAMADNSQHTDTSTDIDTDDKTQLNGGHQGMLLATNCSDQSNVKSSDQRTLRRLAQNREAARKSRLRKKAYVQQLENSRIRLAQLEEELKRARQQGSLVERGVSADHTHLAAGNGVFSFELEYTRWKEEHQRMINDLRSGVNSQLGDNDLRVLVDAVMSHYDEIFRLKGIGTKVEVFHMLSGMWKTPAERFFMWLGGFRSSELLKILGNHVDPLTDQQLIGICNLQQSSQQAEDALSQGMEALQQSLLETLSSASMGPNSSANVADYMGHMAMAMGKLGTLENFLRQADLLRQQTLQQLHRILTTRQAARAFLVIHDYISRLRALSSLWLARPRD

SEQ ID NO: 2139 - DNA, 977 bp, Arabidopsis thaliana
  G1808  Predicted polypeptide sequence is paralogous to G1047
aattcttcccttttccccttctaatttctctcatctctctattagaaaaattattagcaattatgttgtccactgcaccggccttttcattctccgaaccgggtttggttaatcaattctcgggtttccaaaccgggttcactccttgggaatgggattgctctgatctctttttcgtggaccaaatgtctcttgaaccggccatccctagtccttgttatggtgaatccgacactggttccgtcaaaattaattccggttctcatgacatgaaaaccggttctgacgaatcttgtgccggtttcgtcaaaattaatcctcgttgtgacgacgccgacatatcaaacgatctaccgtgctctcaagcagatgaaccggactcggacgacacaaaacaattgacagccatcacaaatttcggttcgggagagaataaccataaccggaaaaaaatgatccaaccggagatgaccgacgagcggaagaggaagaggatggagtcaaaccgggaatcagcgaaacggtcaagaatgcgtaaacaaagtcacattgataacttacgagagcaagtaaaccggttggatttagaaaaccgtgagctcgggaaccgactccggttagttttacaccagcttcaacgagtgaattccgacaataaccggctcgtgacagaacaagagatactccggctaagattgtcggagatgcgtcggattctgatcattagacaacttcaacaacagcaacaatgggaactacataaccggagaatgatcatgactgaacaaaaccaccctcatcttcaatgatagatcaaaatatttaagaagaaaaaatatcgaaaaacttagaacaataaccaaaaaaaaaaagcaaagcaaaaaagaaactctcgctatgtctctctatctctctatgtaaatgaaatgaaggttaggaagagaaaatgatagttttctaattttcctttccacttt

SEQ ID NO: 2140 - protein, 248 aa, Arabidopsis thaliana
  G1808  Paralogous to G1047
MLSTAPAFSFSEPGLVNQFSGFQTGFTPWEWDCSDLFFVDQMSLEPAIPSPCYGESDTGSVKINSGSHDMKTGSDESCAGFVKINPRCDDADISNDLPCSQADEPDSDDTKQLTAITNFGSGENNHNRKKMIQPEMTDERKRKRMESNRESAKRSRMRKQSHIDNLREQVNRLDLENRELGNRLRLVLHQLQRVNSDNNRLVTEQEILRLRLSEMRRILIIRQLQQQQQWELHNRRMIMTEQNHPHLQ

SEQ ID NO: 2141 - DNA, 318 bp, Arabidopsis thaliana
  G1816  Predicted polypeptide sequence is paralogous to G226, G682
atggataacactgaccgtcgtcgccgtcgtaagcaacacaaaatcgccctccatgactctgaagtgagcagtatcgaatgggagtttatcaacatgactgaacaagaagaagatctcatctttcgaatgtacagacttgtcggtgataggtgggatttgatagcaggaagagttcctggaagacaaccagaggagatagagagatattggataatgagaaacagtgaaggctttgctgataaacgacgccagcttcactcatcttcccacaaacataccaagcctcaccgtcctcgcttttctatctatccttcctag

SEQ ID NO: 2142 - protein, 105 aa, Arabidopsis thaliana
  G1816  Paralogous to G226, G682
MDNTDRRRRRKQHKIALHDSEVSSIEWEFINMTEQEEDLIFRMYRLVGDRWDLIAGRVPGRQPEEIERYWIMRNSEGFADKRRQLHSSSHKHTKPHRPRFSIYPS

SEQ ID NO: 2143 - DNA, 765 bp, Arabidopsis thaliana
  G1839  Predicted polypeptide sequence is paralogous to G1749
atcacagttatgtttccattcattggctataaaaaccatgctcactcccttttgttcttcacaccatttgcaggaaaaaatgaatagttgtcagtctaatcccaccaaaatggataattcagaaaatgttctatttaatgatcaaaacgaaaatttcacacttgttgcaccacacccttcttcttcgtacttgacaagagatcaagagcacgagatcatggtctctgctctgcgacaagtgatatctaactccggagctgacgacgcgtcatcatcaaacttgatcatcacaagcgttccgcctccagacgctggcccttgtcctctctgtggcgtcgccggttgctacggctgcacattacaacggccgcaccgagaggtaaagaaggagaagaaatacaaaggagtaaggaaaaaaccatcgggtaaatgggcggcggagatatgggatccgagatcgaaatcaaggaggtggcttggaacgtttcttacggcggagatggcggcacaatcttacaatgatgcggcggctgagtatcgagcaagacgtggtaaaacaaacggagaaggaattaaacggcggtggagatgactgagaaggacatggtcggtgatcatacacggcgaggtggaaatgttatatttactattgaaaactaaattatttattatagagggagatattactctttacgctttcattaagatttatttttataagttttaaagtattttattgttataaaaaaaaaaaaaaaaaaaaaa

SEQ ID NO: 2144 - protein, 184 aa, Arabidopsis thaliana
  G1839  Paralogous to G1749
MLTPFCSSHHLQEKMNSCQSNPTKMDNSENVLFNDQNENFTLVAPHPSSSYLTRDQEHEIMVSALRQVISNSGADDASSSNLIITSVPPPDAGPCPLCGVAGCYGCTLQRPHREVKKEKKYKGVRKKPSGKWAAEIWDPRSKSRRWLGTFLTAEMAAQSYNDAAAEYRARRGKTNGEGIKRRWR

SEQ ID NO: 2145 - DNA, 834 bp, Arabidopsis thaliana
  G1844  Predicted polypeptide sequence is paralogous to G157, G859, G1842, G1843
agaaattaggggattagatgtgtcggaagagtgaagccatgggaagaagaagagtagagatcaaacgaattgagaacaaaagcagtagacaagtcactttctgtaagagacgaaatggtctcatggagaaagctcgtcaactctcaattctctgtggatcctccgtcgctcttttcatcgtctcttccaccggcaaactctacaactcctcctccggcgacagcatggccaagatcatcagtcgttttaaaatacaacaagctgatgatcctgaaaccttggatcttgaagacaaaactcaggattatctttcacacaaggagttactagaaatagttcaaagaaagattgaagaagcaaaaggggataatgtaagtatagaatctctaatttccatggaagagcagctcaagagtgctctgtctgtaattagagctaggaagacagagttattgatggagcttgtgaagaaccttcaggataaggagaagttgctgaaagaaaagaacaaggttctagctagcgaggtggggaagctgaagaaaattttggaaacaggggatgaaagagcagtaatgtcaccggaaaatagctctggccacagcccaccggagactctcccgcttctcaagtaaccaccaatcatcaacggctgatttttcatcatcctgattcaaaaaaggtaaaaaaaattcatgtgtaaaaatcataaagaagctacatgttttaaaatcctcttctccccctgcatacggataaatttatagaccaaaaatataatgttttccctcaaataagatatcgacctttgtgttaccttggaagacaggatca

SEQ ID NO: 2146 - protein, 198 aa, Arabidopsis thaliana
  G1844  Paralogous to G157, G859, G1842, G1843
MGRRRVEIKRIENKSSRQVTFCKRRNGLMEKARQLSILCGSSVALFIVSSTGKLYNSSSGDSMAKIISRFKIQQADDPETLDLEDKTQDYLSHKELLEIVQRKIEEAKGDNVSIESLISMEEQLKSALSVIRARKTELLMELVKNLQDKEKLLKEKNKVLASEVGKLKKILETGDERAVMSPENSSGHSPPETLPLLK

SEQ ID NO: 2147 - DNA, 729 bp, Arabidopsis thaliana
  G1888  Predicted polypeptide sequence is paralogous to G1482
atgaagatttggtgtgctgtttgtgataaagaagaagcttcggtgttttgttgtgcggatgaagcagctctttgtaatggttgcgatcgccatgttcatttcgccaataaactagccgggaaacatctccggttctctctcacttctcctactttcaaagatgctcctctttgtgatatttgcggggagaggcgtgcattattattttgccaagaagacagagcaatactatgcagagaatgtgacattccaatacatcaagctaatgagcacactaagaaacacaatagattcctccttaccggcgttaagatctctgcctccccgtcagcctacccaagagcctccaattccaactctgctgctgcatttggtcgagccaaaacccgaccaaaatcagtatcgagcgaggtcccgagctcggcctccaatgaggtatttacgagctcttcttcgacgaccacgagcaattgctattatgggatagaagaaaactaccatcacgtgagcgattcggggtcgggatcgggttgtacaggtagtatatccgagtatttgatggagacattaccgggttggagagtggaggatttgcttgaacacccttcttgtgtctcctatgaggataacattattactaataacaataacagtgagtcttatagggtttatgatggttcttcacaattccatcatcaagggttttgggatcacaaacccttctcttga

SEQ ID NO: 2148 - protein, 242 aa, Arabidopsis thaliana
  G1888  Paralogous to G1482
MKIWCAVCDKEEASVFCCADEAALCNGCDRHVHFANKLAGKHLRFSLTSPTFKDAPLCDICGERRALLFCQEDRAILCRECDIPIHQANEHTKKHNRFLLTGVKISASPSAYPRASNSNSAAAFGRAKTRPKSVSSEVPSSASNEVFTSSSSTTTSNCYYGIEENYHHVSDSGSGSGCTGSISEYLMETLPGWRVEDLLEHPSCVSYEDNIITNNNNSESYRVYDGSSQFHHQGFWDHKPFS

SEQ ID NO: 2149 - DNA, 625 bp, Arabidopsis thaliana
  G1889  Predicted polypeptide sequence is paralogous to G353, G354
acacgatcaaaactcattattcaacaaagtcttcgtttcatttttcatttttcatttctcaaccaaaaaaaaaaagagtgattttttttttaatcatcagtcaaatggaaaggggaagatcagatatggagatgataaacaacatggcaaattgcttgattcttctatcaaaggcccatcaaaacgacaccaaaagccgtgttttcgcgtgcaagacatgcaacaaagagttcccgtcgttccaagccttgggaggtcaccgagccagccaccggcgatccgcagcgcttgaaggccacgcacctccttctcctaagagagtcaaaccggtgaaacacgagtgtcccatatgtggtgctgagttcgcggtagggcaggccttaggtggtcacatgaggaagcatagaggtggatcaggaggaggaggtggccggagtttggcgccggctacagcgccggtgacgatgaagaaatcaggcggtggtaatggaaaaagagttttgtgtttggacttgaacttgacgcctttagagaacgaagatttgaagttggagcttgggaggtttattttctgatttttgttcgtttttctttttagggtatacttgtgtagggtaagtttatt

SEQ ID NO: 2150 - protein, 156 aa, Arabidopsis thaliana
  G1889  Paralogous to G353, G354
MERGRSDMEMINNMANCLILLSKAHQNDTKSRVFACKTCNKEFPSFQALGGHRASHRRSAALEGHAPPSPKRVKPVKHECPICGAEFAVGQALGGHMRKHRGGSGGGGGRSLAPATAPVTMKKSGGGNGKRVLCLDLNLTPLENEDLKLELGRFIF

SEQ ID NO: 2151 - DNA, 366 bp, Arabidopsis thaliana
  G1929  Predicted polypeptide sequence is paralogous to G1478
atgtgtagaggcttgaataatgaagagagcagaagaagtgacggaggaggttgccggagtctctgcacgagaccgagtgttccggtaaggtgtgagctttgcgacggagacgcctccgtgttctgtgaagcggactcggcgttcctctgtagaaaatgtgaccggtgggttcatggagcgaattttctagcttggagacacgtaaggcgcgtgctatgcacttcttgtcagaaactcacgcgccggtgcctcgtcggagatcatgacttccacgttgttttaccgtcggtgacgacggtcggagaaaccaccgtggagaatagaagtgaacaagataatcatgaggttccgtttgtttttctctga

SEQ ID NO: 2152 - protein, 121 aa, Arabidopsis thaliana
  G1929  Paralogous to G1478
MCRGLNNEESRRSDGGGCRSLCTRPSVPVRCELCDGDASVFCEADSAFLCRKCDRWVHGANFLAWRHVRRVLCTSCQKLTRRCLVGDHDFHVVLPSVTTVGETTVENRSEQDNHEVPFVFL

SEQ ID NO: 2153 - DNA, 1130 bp, Arabidopsis thaliana
  G1945  Predicted polypeptide sequence is paralogous to G2155
atttcccaaagggatttacgaaaagtccctctcctctatcatctctttattcaccccataccaacaacctctacatcttcttcttcttcttcctcctcttttattttctttttaaatcatttacacaaaaatccaaagacaaatctgaaatctctaataaacaaatccataaaataagaaaaacaaagatgaaaggtgaatacagagagcaaaagagtaacgaaatgttttccaagcttcctcatcatcaacaacaacagcaacaacaacaacaacaacactctcttacctctcacttccacctctcctccaccgtaacccccaccgtcgatgactcctccatcgaagtggtccgacgtccacgtggcagaccaccaggttccaaaaacaaacctaaaccacccgtcttcgtcacacgtgacaccgaccctcctatgagtccttacatcctcgaagttccttcaggaaacgacgtcgtcgaagccatcaaccgtttctgccgccgtaaatccatcggagtctgcgtccttagtggctctggctctgtagctaacgtcactttacgtcagccatcaccggcagctcttggctctaccataactttccatggaaagtttgatctcctctccgtctccgcaacgtttctccctcctccgcctcgtacttccttgtctcctcccgtttctaacttcttcaccgtctctctcgctggacctcaaggacaaatcatcggagggttcgtcgctggtccacttatttcggcaggaacagtttacgtcatcgccgcaagtttcaacaacccttcttatcaccggttaccggcggaagaagagcaaaaacactcggcggggacaggggaaagagagggacaatctccgccggtctctggtggcggtgaagagtcaggacagatggcgggaagtggaggagagtcgtgtggggtatcaatgtacagttgccacatgggtggctctgatgttatttgggcccctacagccagagctccaccgccatactaaccaatccttctttcacaaatctctttctttctttttttgtttttttttgttttgggttaggatgaatcaagaaactagggttttttttttttttttttaaaaaaaaaaaaa

SEQ ID NO: 2154 - protein, 276 aa, Arabidopsis thaliana
  G1945  Paralogous to G2155
MKGEYREQKSNEMFSKLPHHQQQQQQQQQQHSLTSHFHLSSTVTPTVDDSSIEVVRRPRGRPPGSKNKPKPPVFVTRDTDPPMSPYILEVPSGNDVVEAINRFCRRKSIGVCVLSGSGSVANVTLRQPSPAALGSTITFHGKFDLLSVSATFLPPPPRTSLSPPVSNFFTVSLAGPQGQIIGGFVAGPLISAGTVYVIAASFNNPSYHRLPAEEEQKHSAGTGEREGQSPPVSGGGEESGQMAGSGGESCGVSMYSCHMGGSDVIWAPTARAPPPY

SEQ ID NO: 2155 - DNA, 513 bp, Arabidopsis thaliana
  G1974  Predicted polypeptide sequence is paralogous to G353, G354
atggttgctgaaagtgataatcgtgatctgacggtggatacggcggcgagctgtctgatgttgttatcaggaattggagaacacgacggaagaaagaaacgtgttttccgatgcaagacttgtgagagagacttcgattcgttccaagctttaggaggccaccgtgcaagccactcgaaactaaccaacagtgacgataaatcacttcctggatcaccaaagaagaagcctaaaactacgactacgacgacggctcatacttgtccgatttgtggcttggagtttccgatgggacaagctcttggtggtcacatgaggaaacataggaacgagaaagaacgagaaaaggcttctaacgtattggttacgcattctttcatgccggagacgacaacggtgacgactttgaagaaatcgagtagtgggaagagagtggcgtgtttggatttcgacttaacttcggtggagagctttgtcaacacggaattggagttgggaagaacgatgtactga

SEQ ID NO: 2156 - protein, 170 aa, Arabidopsis thaliana
  G1974  Paralogous to G353, G354
MVAESDNRDLTVDTAASCLMLLSGIGEHDGRKKRVFRCKTCERDFDSFQALGGHRASHSKLTNSDDKSLPGSPKKKPKTTTTTTAHTCPICGLEFPMGQALGGHMRKHRNEKEREKASNVLVTHSFMPETTTVTTLKKSSSGKRVACLDFDLTSVESFVNTELELGRTMY

SEQ ID NO: 2157 - DNA, 762 bp, Arabidopsis thaliana
  G1995  Predicted polypeptide sequence is paralogous to G361, G362
atggacgaggctaccggagaaacagaaactcaagatttcatgaacgtcgaatccttctctcagcttcctttcattcgccgtcctaaagataagaaccctaaacccattcgtgtcttcggaaaagatttcaccggcagagatttctctattactaccggtcaagaagactacaccgatccttaccagaccaaaaacaaagaagaagaagaggaagaagaccaaaccggagacaacagtacggacaataatagcatcagccacaacaggagattcgagtgtcactattgctttagaaattttcctacttcacaagccctaggtggacaccaaaacgctcacaaacgcgaacgtcagcttgccaaacgcggtgtttcctcttacttttatcatcctgacaataacccttacagttaccgtcattacccgtcgtggaccaatggtccgttaaccgcggctaggtcctatggaggattttcttctggtcctaagccgtcggggtattattcacgacccagctatgggagtcagttaggactatggcgtctaccgcctcgcgttcaaggcgtttataactcaaacgcagcgtttactagtaatggctcttcttcttcttctaattcgactttaccgttgttgacccgttctcaaactcaactatcatcgcaagtgggtggctccgctgctcagaacagaatgtcatcgtacggttacggattgagccctaacgtgcaagatcatgtgagtctcgatcttcatctttaa

SEQ ID NO: 2158 - protein, 253 aa, Arabidopsis thaliana
  G1995  Paralogous to G361, G362
MDEATGETETQDFMNVESFSQLPFIRRPKDKNPKPIRVFGKDFTGRDFSITTGQEDYTDPYQTKNKEEEEEEDQTGDNSTDNNSISHNRRFECHYCFRNFPTSQALGGHQNAHKRERQLAKRGVSSYFYHPDNNPYSYRHYPSWTNGPLTAARSYGGFSSGPKPSGYYSRPSYGSQLGLWRLPPRVQGVYNSNAAFTSNGSSSSSNSTLPLLTRSQTQLSSQVGGSAAQNRMSSYGYGLSPNVQDHVSLDLHL

SEQ ID NO: 2159 - DNA, 1014 bp, Arabidopsis thaliana
  G1998  Predicted polypeptide sequence is paralogous to G325
atggagccaaagtgtgaccattgtgcaacctcgcaagcattgatttactgcaaatccgatttggctaaactatgcctaaactgcgacgtccatgtacactctgcgaatcctctgtctcacaggcacatacgctctttgatctgcgagaaatgcttctcacagccagccgcaatccgctgtctcgacgagaaggtttcatactgccaaggatgtcattggcacgaaagcaactgttcggagttaggacacagagttcagagcttgaatcctttctctggttgtccttctcctacagattttaacagaatgtggtcttcaattcttgaacctcctgtctccggcttgcttagtccgttcgttggttcttttcccttgaatgatctcaacaataccatgttcgataccgcttattccatggtaccacacaacatcagttacactcagaatttcagtgataatttgtctttcttttccacggaatctaagggatatcctgatatggttcttaaacttgaagaaggagaagaagatctatgtgaagggcttaacttggatgatgcaccattaaactttgacgtaggagatgatattatcggatgttcatcagaagtacacatagaaccggaccatacggcatcgccaccaggtcagcaaatgaacatcaacactggacttcagcttcctctatcacctgtcttgttcggacaaatccatccatctcttaacatcactggtgaaaacaatgcagctgattaccaggattgtgggatgtctccagggtttataatgagtgaagcgccatgggaaacgaattttgaagttagttgtccacaagcaagaaacgaggctaagttgagatacaaggagaagaaattaaagcgctcttttgggaaacagattcgatatgcatctcgcaaagcaagagctgacacgaggaaaagagtgaaaggaagatttgtgaaagctggtgacagttatgattatgatccatcatcaccgacgacgaacaattga

SEQ ID NO: 2160 - protein, 337 aa, Arabidopsis thaliana
  G1998  Paralogous to G325
MEPKCDHCATSQALIYCKSDLAKLCLNCDVHVHSANPLSHRHIRSLICEKCFSQPAAIRCLDEKVSYCQGCHWHESNCSELGHRVQSLNPFSGCPSPTDFNRMWSSILEPPVSGLLSPFVGSFPLNDLNNTMFDTAYSMVPHNISYTQNFSDNLSFFSTESKGYPDMVLKLEEGEEDLCEGLNLDDAPLNFDVGDDIIGCSSEVHIEPDHTASPPGQQMNINTGLQLPLSPVLFGQIHPSLNITGENNAADYQDCGMSPGFIMSEAPWETNFEVSCPQARNEAKLRYKEKKLKRSFGKQIRYASRKARADTRKRVKGRFVKAGDSYDYDPSSPTTNN

SEQ ID NO: 2161 - DNA, 845 bp, Arabidopsis thaliana
  G2107  Predicted polypeptide sequence is paralogous to G912, G913
accacaaaacagagcaacacacaacacaaagcttcatttcaattctgtttcgagaaccctttgagaaccagatcggagatggaaaacgacgatatcaccgtggcggagatgaagccaaagaagcgtgctggacggaggattttcaaggagacacgtcacccaatctacagaggcgtgcggcgtagggacggcgacaaatgggtatgcgaagtccgtgaaccgattcatcagcgtcgagtctggctcggaacttatccgacggcagatatggccgcacgtgctcacgacgtggcggttcttgctctgcgcgggagatccgcgtgtttgaatttctccgattctgcttggaggttgccggtgccggcatccactgatccggacacgatcaggcgcacggcggccgaagcagcggagatgttcaggccgccggagtttagtacaggaattacggttttaccctcagccagtgagtttgacacgtcggatgaaggagtcgctggaatgatgatgaggctcgcggaggagccgttgatgtcgccgccaagatcgtacattgatatgaatacgagtgtgtacgtggacgaagaaatgtgttacgaagatttgtcactttggagttactaaaatacgtatgtgttaaaaaaccaaagatcgtatgtgtatgtatgcataataaatgggcttaatgatgggcatagatatgataggtccagcctatatgttaaatgtgttttattttttggtttatctagtttcctaggtatttaccaaattgtattagtataagttttattaagaaataatcaaaaatgttgttgccaaaaaaaaaaaaaaaaaaaaaaaaa

SEQ ID NO: 2162 - protein, 181 aa, Arabidopsis thaliana
  G2107  Paralogous to G912, G913
MENDDITVAEMKPKKRAGRRIFKETRHPIYRGVRRRDGDKWVCEVREPIHQRRVWLGTYPTADMAARAHDVAVLALRGRSACLNFSDSAWRLPVPASTDPDTIRRTAAEAAEMFRPPEFSTGITVLPSASEFDTSDEGVAGMMMRLAEEPLMSPPRSYIDMNTSVYVDEEMCYEDLSLWSY

SEQ ID NO: 2163 - DNA, 1065 bp, Arabidopsis thaliana
  G2131  Predicted polypeptide sequence is paralogous to G979
gtctctcattttcataattccattttcaggattgtctctcaatcttttattcttctcattcaccggtaatggcaaaagtctctgggaggagcaagaaaacaatcgttgacgatgaaatcagcgataaaacagcgtctgcgtctgagtctgcgtccattgccttaacatccaaacgcaaacgtaagtcgccgcctcgaaacgctcctcttcaacgcagctccccttacagaggcgtcacaaggcatagatggactgggagatacgaagcgcatttgtgggataagaacagctggaacgatacacagaccaagaaaggacgtcaagtttatctaggggcttacgacgaagaagaagcagcagcacgtgcctacgacttagcagcattgaagtactggggacgagacacactcttgaacttccctttgccgagttatgacgaagacgtcaaagaaatggaaggccaatccaaggaagagtatattggatcattgagaagaaaaagtagtggattttctcgcggtgtatcaaaatacagaggcgttgcaaggcatcaccataatgggagatgggaagctagaattggaagggtgtttggtaataaatatctatatcttggaacatacgccacgcaagaagaagcagcaatcgcctacgacatcgcggcaatagagtaccgtggacttaacgccgttaccaatttcgacgtcagccgttatctaaaccctaacgccgccgcggataaagccgattccgattctaagcccattcgaagccctagtcgcgagcccgaatcgtcggatgataacaaatctccgaaatcagaggaagtaatcgaaccatctacatcgccggaagtgattccaactcgccggagcttccccgacgatatccagacgtattttgggtgtcaagattccggcaagttagcgactgaggaagacgtaatattcgattgtttcaattcttatataaatcctggcttctataacgagtttgattatggaccttaatcgtattttctacaagttttgttttgattatctacacaatacatcaatatattct

SEQ ID NO: 2164 - protein, 313 aa, Arabidopsis thaliana
  G2131  Paralogous to G979
MAKVSGRSKKTIVDDEISDKTASASESASIALTSKRKRKSPPRNAPLQRSSPYRGVTRHRWTGRYEAHLWDKNSWNDTQTKKGRQVYLGAYDEEEAAARAYDLAALKYWGRDTLLNFPLPSYDEDVKEMEGQSKEEYIGSLRRKSSGFSRGVSKYRGVARHHHNGRWEARIGRVFGNKYLYLGTYATQEEAAIAYDIAAIEYRGLNAVTNFDVSRYLNPNAAADKADSDSKPIRSPSREPESSDDNKSPKSEEVIEPSTSPEVIPTRRSFPDDIQTYFGCQDSGKLATEEDVIFDCFNSYINPGFYNEFDYGP

SEQ ID NO: 2165 - DNA, 1361 bp, Arabidopsis thaliana
  G2156  Predicted polypeptide sequence is paralogous to G1073
ttttttttccctttcctcgttcaaaaaaagtacttgcagagtcactcactctcagtctcagcacatgaattaatttgaagcttccctagaattctttcacatcaattaatacgacaccgtctcgggtgaagaatctctcctctcttgccctaaagcgagttagggtttaacacacaaagcataccctttagatttgtgtctcttagctctgtttttgtcggcttgtgtaaccgatcaactcaagctattggctcctcacctcctgaaatttgacttctccaatggatctcaaagtttctcttatatgaattctatcttcaccctcacaatatctttatatatatgagccacaagaacaagaagagtcagtagatgcggctgccatggacggtggttacgatcaatccggaggagcttctagatactttcacaacctcttcaggcctgagcttcatcaccagcttcaacctcagcctcaacttcaccctttgcctcagcctcagcctcaacctcagcctcagcagcagaattcagatgatgaatctgactccaacaaggatccgggttccgacccagttacctctggttcaaccgggaaacgtccacgtggacgtcctccgggatccaagaacaagccgaagccaccggtgatagtgactagagatagccccaacgtgcttagatctcatgttcttgaagtctcatctggagccgacatagtcgagagcgttaccacttacgctcgcaggagaggaagaggagtctccattctcagtggtaacggcacggtggctaacgtcagtctccggcagccggcaacgacagcggctcatggggcaaatggtggaaccggaggtgttgtggctctacatggaaggtttgagatactttccctcacaggtacggtgttgccgccccctgcgccgccaggatccggtggtctttctatctttctttccggcgttcaaggtcaggtgattggaggaaacgtggtggctccgcttgtggcttcgggtccagtgatactaatggctgcatcgttctctaatgcaactttcgaaaggcttccccttgaagatgaaggaggagaaggtggagagggaggagaagttggagagggaggaggaggagaaggtggtccaccgccggccacgtcatcatcaccaccatctggagccggtcaaggacagttaagaggtaacatgagtggttatgatcagtttgccggtgatcctcatttgcttggttggggagccgcagccgcagccgcaccaccaagaccagccttttagaattgaaaattatgtccgtaacatagctgtaaccaaatttcatttctcaaaattaaaagaaaaaaaaaa

SEQ ID NO: 2166 - protein, 302 aa, Arabidopsis thaliana
  G2156  Paralogous to G1073
MDGGYDQSGGASRYFHNLFRPELHHQLQPQPQLHPLPQPQPQPQPQQQNSDDESDSNKDPGSDPVTSGSTGKRPRGRPPGSKNKPKPPVIVTRDSPNVLRSHVLEVSSGADIVESVTTYARRRGRGVSILSGNGTVANVSLRQPATTAAHGANGGTGGVVALHGRFEILSLTGTVLPPPAPPGSGGLSIFLSGVQGQVIGGNVVAPLVASGPVILMAASFSNATFERLPLEDEGGEGGEGGEVGEGGGGEGGPPPATSSSPPSGAGQGQLRGNMSGYDQFAGDPHLLGWGAAAAAAPPRPAF

SEQ ID NO: 2167 - DNA, 1674 bp, Arabidopsis thaliana
  G2184  Predicted polypeptide sequence is paralogous to G1927
atggcggattcttcacccgattcgtgtttcaaaggaggcaaatttagtgctccagggtttcgatttcatccaactgatgaagagcttgtgatgtattatttgaagaggaagatttgtaggaagaggcttagagttaatgttatcggtgttgttgatgtttacaaaatggatcctgaggaattgcctggtcaatcaatgttgaagacgggagatagacagtggttctatttcactccaaggagtaggaagtatccaaacgcagctaggtctaatagaggaactgaaaatgggtattggaaggctacagggaaggatcgagtcattgagtataattctagatcggtgggacttaaaaagactcttgttttctatagaggccgggctcctagtggtgagcggactgattgggtgatgcatgagtatacgatggatgaagatgaactagggagatgtaagaaccctcaggagtactatgctctttataagttgttcaagaaaagtggggctggtcctaagaatggtgaacagtatggtgctccgtttcaagaagaggaatgggttgatgatgataatgaagatgtgaatgctattgctgtagctgtgccagagcaacctgtggttcgttatgaggatgctcgtcgtgtggatgagaggagactttttaatcctgttattcttcagttagaggatatcgatgagcttctcaatggaatccctaatgcacctggtgttcctcaaagatgtattcctcaggtgaatagtgaagaagagctgcagagtacgttggtgaataattctgctagagagttcttgccaaacggtcagcaatacaacaggccctcaagttttgactcattagagaccgctgaggtcacctcagctcctctggtgtttgagaaggaagatttcattgaaatggatgatcttcttctgatccctgaattcggagcttcttcaactgagaaagccgcacagttctcgaaccatggtgaattcgacgattttaatgagtttgaccaattgttccatgacgtttccatgtctttggatatggaacctattgatcagggaacttctgcaaatctgtcttctctgagtgattctgctaactacacatcagaccaaaaacagcaactcctttatcaacagttccaggaccagactcccgagaaccagctgaacaacatcatggatcctagtacaactctcaatcaaatcactagcgatatttggttcgaggatgatcaggccattctatttgatcaacaacaatccttttctggagcatttgcttcaccctcatcaggtgtgatgcctgattccaccaatcctactatgagtgtgaatgcccaaggccatgaaatccaaaatggtggtggaacaacaagccagttctcatcggctttgtgggcattaatggactcaataccttcaacgccagcctctgcgtgtgagggtccccttaaccgaacctttgtacgtatgtctagcttcagccgtatgaggttcaatggaaaggctaatggaacgccagtgagtactaccatagcaaagaagggtattagaaacagaggttttcttctattatcaatcgtgggtgctttgtgtgccatcttctgggtgttggtagccacagttcgagtctcaggtagaagtcttctcttgaaagactag

SEQ ID NO: 2168 - protein, 557 aa, Arabidopsis thaliana
  G2184  Paralogous to G1927
MADSSPDSCFKGGKFSAPGFRFHPTDEELVMYYLKRKICRKRLRVNVIGVVDVYKMDPEELPGQSMLKTGDRQWFYFTPRSRKYPNAARSNRGTENGYWKATGKDRVIEYNSRSVGLKKTLVFYRGRAPSGERTDWVMHEYTMDEDELGRCKNPQEYYALYKLFKKSGAGPKNGEQYGAPFQEEEWVDDDNEDVNAIAVAVPEQPVVRYEDARRVDERRLFNPVILQLEDIDELLNGIPNAPGVPQRCIPQVNSEEELQSTLVNNSAREFLPNGQQYNRPSSFDSLETAEVTSAPLVFEKEDFIEMDDLLLIPEFGASSTEKAAQFSNHGEFDDFNEFDQLFHDVSMSLDMEPIDQGTSANLSSLSDSANYTSDQKQQLLYQQFQDQTPENQLNNIMDPSTTLNQITSDIWFEDDQAILFDQQQSFSGAFASPSSGVMPDSTNPTMSVNAQGHEIQNGGGTTSQFSSALWALMDSIPSTPASACEGPLNRTFVRMSSFSRMRFNGKANGTPVSTTIAKKGIRNRGFLLLSIVGALCAIFWVLVATVRVSGRSLLLKD

SEQ ID NO: 2169 - DNA, 4127 bp, Arabidopsis thaliana
  G2334  Predicted polypeptide sequence is paralogous to G1863
ttactctgctggctcagtgtttacatacctgttcgcgtaatctaaatactcctgcaagtaacaaacaatcaaacataaaaattatcaagaaggaaatacaagaacagattccattggtctttaaatgaatattagtaaccttacctgaagtataactactgcggctaacttgtccaacattgtcttctcttgaacaggatgcaaattcaagggcttcaacatcagttcaacggtctgttgacagtattacatgagattcaagggatattaaacttaacacctatctttactgtgacttacaagatctttaaatctgaaaaatatatacctttgatgataatcgctcgtcccaatatgtgtatttcacatccttgagtttttcggtcttacgaagttcctcaatgaaaagattcacagtgacaacctgttccaagtttaaaaatccttttcggttatatgagctaatgtagaggaaaagtacttcacaattcagtcgaaacaaaaaaaaaaacttacatcctctacattgttcagtttgccaaatggataaccaacgactaatcccgacacagaaaatgctttgacctgcataagacaacaaaaggcaaatgattgatgtaatcaaacagagttcataagtctacttgttgatagatctctactacgtcaaggacttaacagtaaacactaactgaataaaccttgatcctttaatcaccagtaaggcagtaatcacaaaaagccgagggtgaaagtagacactaatctactacactaacaaactttcttcttcattaccaaaacaaacgatagtttcttcattccttatcttagtaaacactaatctacactagcaaccttttttctttgttttaaaaaacactaagaaatgatagtttctccatttcttaacaagaactaaaatctgtgtatttgtttaaggtctcctttaaatctagagctaaaaagtaaaggaacgatcaaacttatagcacctaccaggttctggaaatctgtagccatcaggtcaatgtttgatttctttctgagcaaaacactgcaagagaagtaacaggttttcaatagcgatgatggtgacaaaattgatcagagaggatttgcatttttgaaaattactgttaaacaaatgttgtagcatgtagacactgaatcaaaggtacctcaatggagaagcaaccatatttgaaggatctgagatagctaatccaacatacttatcaccaacatctaaacccagaaaccgaccagggactgacactttggtcttcagcgcattacccaataagctcaatggcttcacatacttcatttcctgatcaaaagtaagtgaatcaaacttccaaaacacttgttcaaatcaagactaaaaattcacatatcaattgcataaatttgagaattattgtacaaaaaaaactttaatcagaccatcaaacaaacatttcgaaaaagggttttagaaattaatcagaaagtttaaatcttgacgtactttaaaggcggaaactttctggctccggagcacggaatctggcgagaggaaacgacaaatggttctgctaaatgtcttcgcgattgaagcaagcaagcacaaaccccaagattgtgaattagagatggaccggaaaaggtttattccggttaagttcgagacttcaccgtctaatcaatctatacgatgccggtgattatcagggttttggttttacattataccgggaaccggttaattcgaggtggtttaactggtttcccaaaattgattcggtttagcttaagtgaaaagctcaagtaaccacctctcctgtacttacttgcaggcagaggatcatattagtttcattgcttatacaaaattgtcaagctttaaacataaatataatagcagagtaaggaacaaaacaattccaaaagcagaactcacaattccaaaagaagacaaattcaaagattattttctgcagaaaataaagattcaaagagcacaaaccaaaaagattacaaacacttttctttaatgaaaaacttgagtagagattcccatctgatgaagaacacttgacgtcgaagaagctgacctcaaagcctcagctaatggtcctcccatattgttgtggtgattccctccattgctccaccaattcatttgctccctctcattgttgttatttctcatgttctcttcttcttcttcattgcctgtggaaagttttagagaaacatctgaggacgtgttgttaccgggcatggagattgaaagatgacaagtggatgagctcattggactggaggtagagtctgatgatcgtggccaatcgtcaaagaaatgcctcaagatgtgaccatcgtctgatcttccattgctgaatccactgttagcttcatatggcctcttgttgttgttgctttcttgtttcatctctgaagaacaactgtgacagagaggaataaacataaacataaacattgtcaacaaaaagatccaacatttgaacaataataagtagactgatcaattcaacaaaatggttagagaaataatttaatcagtcaaatgtgtgtgttaataagaggaagtggttgcagaatctgagagctttattttgtttggcttctatgcaggtttggtcagctttcactgaggtcctaccatgtcattatttcaaatacaacataagtatacatatctctttaactttctctctcttttctatttctatgattgaaaagtctcacccaactagtaaataaaattagattctatcaaatccaactgttatcattatctctcaacaaaagaaagaataatgtttttatcacaaagtatgtatgataagtctctcttgtcaccctattgccaacattacccctttcttcacagcattacttcacagtgaaatcactatttccctaacaacaatatttgtaattaaccaaatctactaatgactttaattaaacagagtgtttgtgtttttttattgtacctttgttgatgactaaggtggagaggttgagatgaaccagaggagaagaagtggttgttgtttggtccatgaccaagctcctcacctaagacaaaagaagatgcggttgttgtggctgtcgttgtgatggtggttgtggcggtttccacaggctttcttgaacggtttcttccacggtgaatgtggcggtcacaatacttgtggcccgctacaacatcccttgaacatctccatttcttgccgtcagttctcttacacctccctggctcaggatccattgctcctcttccccaataccctgttttttattaagtgtgtgttgttcattagtaacaacaaacataaatctcactcaagacattggttacgaaatgtacttgtctgattctatctatgttgctaatagatcttctagaaataggcttatcatacacatagggttttaactccttgcaaggttgcagagcagccttatacttattttagatcttggaaatataactccaacaccaaaacaaagggaatcttttttacaaagaaagactatttcaaggataagagaagcataaacaatagagaggagagagagactgacaagaaggttggtgatgaggaaaactatgttgaagaggatggtgaaggaaatgcataggagattgatggaggagacttttcttaataggtaagagaagctcttgaggaacagaagcaccagccaacatgtatctatagatcagtgcttgtagctcaagttcttgccactgtgcccagctgaagaagtttcccatctctacatatatatgtaacatagaaacgtcagattaaatatcagcaaaaacaacttcaacattagagtgaataagtcttgtccttttaaaacaacttactgaggaacctggaagaagaagaagaattagaagagtcaggagagaagcaagagaaagaagaggaagaagtgggttcagggacaaagagaggaagaggagccgcagcagcagaagtagcagtttgggactgaatctgatcaaagaaaaagtttgatatcttagttgcagcagagccttgttcttctgactcattctgctgctgacttctccattgtttcagttgcaagtccat

SEQ ID NO: 2170 - protein, 548 aa, Arabidopsis thaliana
  G2334  Paralogous to G1863
MDLQLKQWRSQQQNESEEQGSAATKISNFFFDQIQSQTATSAAAAPLPLFVPEPTSSSSFSCFSPDSSNSSSSSRFLKMGNFFSWAQWQELELQALIYRYMLAGASVPQELLLPIKKSLLHQSPMHFLHHPLQHSFPHHQPSWYWGRGAMDPEPGRCKRTDGKKWRCSRDVVAGHKYCDRHIHRGRNRSRKPVETATTTITTTATTTASSFVLGEELGHGPNNNHFFSSGSSQPLHLSHQQSCSSEMKQESNNNKRPYEANSGFSNGRSDDGHILRHFFDDWPRSSDSTSSPMSSSTCHLSISMPGNNTSSDVSLKLSTGNEEEEENMRNNNNEREQMNWWSNGGNHHNNMGGPLAEALRSASSTSSVLHQMGISTQEMKYVKPLSLLGNALKTKVSVPGRFLGLDVGDKYVGLAISDPSNMVASPLSVLLRKKSNIDLMATDFQNLVKAFSVSGLVVGYPFGKLNNVEDVVTVNLFIEELRKTEKLKDVKYTYWDERLSSKTVELMLKPLNLHPVQEKTMLDKLAAVVILQEYLDYANRYVNTEPAE

SEQ ID NO: 2171 - DNA, 687 bp, Arabidopsis thaliana
  G2345  Predicted polypeptide sequence is paralogous to G481, G482
atggccgaatcgcaaaccggtggtggtggtggtggaagccatgagagtggcggtgatcagagcccgaggtctttgaatgttcgtgagcaggacaggtttcttccgattgctaacataagccgtatcatgaagagaggtttacctctaaatggcaaaatcgctaaagatgctaaagagactatgcaggaatgtgtctctgaattcatcagcttcgtcaccagcgaggctagtgataagtgccaaagagagaaaaggaagaccatcaatggagatgatttgctttgggctatggccactttaggattcgaagattacatcgatcccctcaaggtttacctgatgcgatatagagagatggagggtgacactaaaggatcaggaaaaggcggggaatcgagtgcaaagagagatggtcaaccaagccaagtgtctcagttctcgcaggttcctcaacaaggctcattctcacagggtccttatggaaactctcaatctctgaggttcggcaatagcatcgagcatcttgaagtgttaatgagtagtactaggacactattcatcacaatcttccgagactcgactatgcctgttgtgtctgagaatctgagtgatccactttccatagatatggattgtgaagctatttatcaccacttcattggcctgttgattctttcatgcaagtga

SEQ ID NO: 2172 - protein, 228 aa, Arabidopsis thaliana
  G2345  Paralogous to G481, G482
MAESQTGGGGGGSHESGGDQSPRSLNVREQDRFLPIANISRIMKRGLPLNGKIAKDAKETMQECVSEFISFVTSEASDKCQREKRKTINGDDLLWAMATLGFEDYIDPLKVYLMRYREMEGDTKGSGKGGESSAKRDGQPSQVSQFSQVPQQGSFSQGPYGNSQSLRFGNSIEHLEVLMSSTRTLFITIFRDSTMPVVSENLSDPLSIDMDCEAIYHHFIGLLILSCK

SEQ ID NO: 2173 - DNA, 762 bp, Arabidopsis thaliana
  G2421  Predicted polypeptide sequence is paralogous to G663
atggagggttcgtccaaagggttgaggaaaggtgcatggactgctgaagaagatagtctcttgaggcagtgtattggtaagtatggagaaggcaaatggcatcaagttcctttaagagctgggctaaatcggtgcaggaaaagttgtagactaagatggttaaactatttgaagccaagtatcaagagaggaaaatttagttctgatgaagttgatcttcttcttcgtcttcataagcttctaggaaataggtggtccttgattgctggtcgattacctggtcggaccgctaatgatgtcaagaactactggaacacccatctgagtaagaagcatgaaccgtgttgtaaaactaagataaaaaggataaatattataacccctcctaatacaccggcccaaaaagtttgtgaaaatagtatcacatgtaacaaagatgatgagaaagatgattttgtggataattttatggttggagataatatatggttggagcgtttgctagacgagggccaagaggtagatgtgctggttacagaagcggcggcaacagaaaaggagggcactttggcgtttgacgttgagcaactttggaatttgttcgatggagagactgtgatctttgattagtgtttataaacgtttgtgttctcttgtttgtgaggtttctctatttaatttagtatctattttctaaattaactaatatcttatagtattttaggcaaaccttatgtttccgtttctgtgcggccgctctag

SEQ ID NO: 2174 - protein, 209 aa, Arabidopsis thaliana
  G2421  Paralogous to G663
MEGSSKGLRKGAWTAEEDSLLRQCIGKYGEGKWHQVPLRAGLNRCRKSCRLRWLNYLKPSIKRGKFSSDEVDLLLRLHKLLGNRWSLIAGRLPGRTANDVKNYWNTHLSKKHEPCCKTKIKRINIITPPNTPAQKVCENSITCNKDDEKDDFVDNFMVGDNIWLERLLDEGQEVDVLVTEAAATEKEGTLAFDVEQLWNLFDGETVIFD

SEQ ID NO: 2175 - DNA, 741 bp, Arabidopsis thaliana
  G2422  Predicted polypeptide sequence is paralogous to G663
atgggcgaatcacccaaagggttgagaaaaggtacatggactactgaagaagatattctcttgaggcaatgcattgataagtatggagaaggcaaatggcatcgagttcctttaagaactggtctcaatcggtgccgaaagagttgtagacttagatggttgaattatttgaagccaagtattaagagaggaaaactctgctccgatgaagttgatcttgttcttcgccttcataaacttctaggaaataggtggtccttgatcgctggtagattgcctggtcggactgctaatgatgtcaagaattactggaacactcatttgagtaagaagcacgatgaacgatgctgtaagacgaagatgataaacaaaaacattacttctcatcctacttcatcggcccaaaaaatcgatgttttaaagcctcggcctcgatccttctccgataaaaatagttgcaacgatgtcaatatcttgccaaaagttgacgttgttcctttacatcttggactcaacaacaattatgtttgtgaaagtagtattacatgtaacaaagatgagcaaaaagataagcttattaatattaatctattggatggagataatatgtggtgggaaagtttactggaggcagatgtgttgggtccagaagctacggaaacagcaaagggtgtgaccttaccgcttgactttgagcaaatttgggctcggtttgatgaagagactttagaactgaattag

SEQ ID NO: 2176 - protein, 246 aa, Arabidopsis thaliana
  G2422  Paralogous to G663
MGESPKGLRKGTWTTEEDILLRQCIDKYGEGKWHRVPLRTGLNRCRKSCRLRWLNYLKPSIKRGKLCSDEVDLVLRLHKLLGNRWSLIAGRLPGRTANDVKNYWNTHLSKKHDERCCKTKMINKNITSHPTSSAQKIDVLKPRPRSFSDKNSCNDVNILPKVDVVPLHLGLNNNYVCESSITCNKDEQKDKLININLLDGDNMWWESLLEADVLGPEATETAKGVTLPLDFEQIWARFDEETLELN

SEQ ID NO: 2177 - DNA, 972 bp, Arabidopsis thaliana
  G2423  Predicted polypeptide sequence is paralogous to G1330
atggatgaaaaaggaagaagcttgaagaacaacaacatggaagacgagatggacctaaagagaggtccgtggactgctgaagaagattttaagctcatgaattacattgctactaatggagaaggtcgctggaactctctttctcgttgcgccggcctccaacgcaccggtaaaagctgtagactaaggtggttaaactatctccgccctgacgtccgccgtggaaacattacacttgaagaacaactcttgatcctcgaacttcattcccgttggggaaatagatggtcaaaaatcgcacaatatttaccgggaagaacggacaacgagatcaagaactactggaggacgcgggtgcaaaagcatgcgaaacagttgaaatgtgatgtgaatagccaacaattcaaagacacaatgaagtacttgtggatgcctcgactagtcgagaggattcagtcagcctcggcctcatccgcagcagcagccaccaccacaaccaccaccaccacaggatcagccggcacgtcatcttgcatcacaacctctaacaatcaattcatgaattacgactacaacaacaacaacatgggacaacagtttggtgtaatgagcaacaatgattatatcacgcctgaaaattccagcgtggcagtgtctccggcgtcagacttaacggagtactacagcgctccaaaccctaacccggaatactattcgggtcaaatggggaatagttattatccagatcagaatttagtgagttcacaattattaccggataattatttcgactatagtggattattagacgaagatctaacggctatgcaagagcagagtaacctcagctggtttgaaaacattaatggtgctgcttcttcttcagacagtttatggaacattggagaaactgatgaagaattctggttcttacagcagcaacaacagttcaacaataatggtagcttctga

SEQ ID NO: 2178 - protein, 323 aa, Arabidopsis thaliana
  G2423  Paralogous to G1330
MDEKGRSLKNNNMEDEMDLKRGPWTAEEDFKLMNYIATNGEGRWNSLSRCAGLQRTGKSCRLRWLNYLRPDVRRGNITLEEQLLILELHSRWGNRWSKIAQYLPGRTDNEIKNYWRTRVQKHAKQLKCDVNSQQFKDTMKYLWMPRLVERIQSASASSAAAATTTTTTTTGSAGTSSCITTSNNQFMNYDYNNNNMGQQFGVMSNNDYITPENSSVAVSPASDLTEYYSAPNPNPEYYSGQMGNSYYPDQNLVSSQLLPDNYFDYSGLLDEDLTAMQEQSNLSWFENINGAASSSDSLWNIGETDEEFWFLQQQQQFNNNGSF

SEQ ID NO: 2179 - DNA, 999 bp, Arabidopsis thaliana
  G2424  Predicted polypeptide sequence is paralogous to G1645
atgaggatggagatggtgcatgctgacgtggcgtctctctccataacaccttgcttcccgtcttctttgtcttcgtcctcacatcatcactataaccaacaacaacattgtatcatgtcggaagatcaacaccattcgatggatcagaccacttcatcggactacttctctttaaatatcgacaatgctcaacatctccgtagctactacacaagtcatagagaagaagacatgaaccctaatctaagtgattacagtaattgcaacaagaaagacacaacagtctatagaagctgtggacactcgtcaaaagcttcggtgtctagaggacattggagaccagctgaagatactaagctcaaagaactagtcgccgtctacggtccacaaaactggaacctcatagctgagaagctccaaggaagatccgggaaaagctgtaggcttcgatggtttaaccaactagacccaaggataaatagaagagccttcactgaggaagaagaagagaggctaatgcaagctcataggctttatggtaacaaatgggcgatgatagcgaggcttttccctggtaggactgataattctgtgaagaaccattggcatgttataatggctcgcaagtttagggaacaatcttcttcttaccgtaggaggaagacgatggtttctcttaagccactcattaaccctaatcctcacattttcaatgattttgaccctacccggttagctttgacccaccttgctagtagtgaccataagcagcttatgttaccagttccttgcttcccaggttatgatcatgaaaatgagagtccattaatggtggatatgttcgaaacccaaatgatggttggcgattacattgcatggacacaagaggcaactacattcgatttcttaaaccaaaccgggaagagtgagatatttgaaagaatcaatgaggagaagaaaccaccatttttcgattttcttgggttggggacggtgtga

SEQ ID NO: 2180 - protein, 332 aa, Arabidopsis thaliana
  G2424  Paralogous to G1645
MRMEMVHADVASLSITPCFPSSLSSSSHHHYNQQQHCIMSEDQHHSMDQTTSSDYFSLNIDNAQHLRSYYTSHREEDMNPNLSDYSNCNKKDTTVYRSCGHSSKASVSRGHWRPAEDTKLKELVAVYGPQNWNLIAEKLQGRSGKSCRLRWFNQLDPRINRRAFTEEEEERLMQAHRLYGNKWAMIARLFPGRTDNSVKNHWHVIMARKFREQSSSYRRRKTMVSLKPLINPNPHIFNDFDPTRLALTHLASSDHKQLMLPVPCFPGYDHENESPLMVDMFETQMMVGDYIAWTQEATTFDFLNQTGKSEIFERINEEKKPPFFDFLGLGTV

SEQ ID NO: 2181 - DNA, 528 bp, Arabidopsis thaliana
  G2432  Predicted polypeptide sequence is paralogous to G736
atggcgacccaagattctcaagggattaaactctttggcaaaaccataacattcaacgccaacatcacacagacgataaaaaaagaagagcagcaacaacaacaacagccagagctacaagcaacaacagccgttagatcaccctcatcggatctgacggctgagaagcgtccagacaagatcataccatgtccgagatgcaagagcatggagactaagttttgttacttcaacaactacaacgttaatcaaccaagacacttctgcaaaggttgtcaacgttactggaccgccggtggagctctccggaatgttcccgtcggtgccggtcgtcggaagtcaaaacctcccggacgtgtcggtgggttcgctgagttgcttggagctgcgactggagctgttgatcaggtcgagctagatgctttgctagtggaagagtggagagctgctacggcgtctcacggtggtttccggcatgattttccggtgaagaggctccgttgttacaccgatggtcaatcttgttaa

SEQ ID NO: 2182 - protein, 175 aa, Arabidopsis thaliana
  G2432  Paralogous to G736
MATQDSQGIKLFGKTITFNANITQTIKKEEQQQQQQPELQATTAVRSPSSDLTAEKRPDKIIPCPRCKSMETKFCYFNNYNVNQPRHFCKGCQRYWTAGGALRNVPVGAGRRKSKPPGRVGGFAELLGAATGAVDQVELDALLVEEWRAATASHGGFRHDFPVKRLRCYTDGQSC

SEQ ID NO: 2183 - DNA, 841 bp, Arabidopsis thaliana
  G2513  Predicted polypeptide sequence is paralogous to G912, G913
tttcaacagtaatttaagttaaccggagtctctttttgttttccggcgaatttttggtactttgagttatgaataatgatgatattattctggcggagatgaggcctaagaagcgtgcgggaaggagagtgtttaaggagacacgtcacccagtttacagaggcataaggcggaggaacggtgacaaatgggtctgcgaagtcagagaaccgacgcaccaacgccgcatttggctcgggacttatcccacagcagatatggcagcgcgtgcacacgacgtggcggttttagctctgcgtgggagatccgcatgtttgaatttcgccgactccgcttggcggcttccggtgccggaatccaatgatccggatgtgataagaagagttgcggcggaagctgcggagatgtttaggccggtggatttagaaagtggaattacggttttgccttgtgcgggagatgatgtggatttgggttttggttcgggttccggctctggttcgggatcggaggagaggaattcttcttcgtatggatttggagactacgaagaagtctcaacgacgatgatgagactcgcggaggggccactaatgtcgccgccgcgatcgtatatggaagacatgactcctactaatgtttacacggaagaagagatgtgttatgaagatatgtcattgtggagttacagatattaagtgggactcacatatctactatacataatatttagcttttatgtaagaggtatttatgtgagttttaagattgtagatgtgtcccaggcgttagaagtttccttgatggtatggaatctttgtacctataaaattataaaatt

SEQ ID NO: 2184 - protein, 209 aa, Arabidopsis thaliana
  G2513  Paralogous to G912, G913
MNNDDIILAEMRPKKRAGRRVFKETRHPVYRGIRRRNGDKWVCEVREPTHQRRIWLGTYPTADMAARAHDVAVLALRGRSACLNFADSAWRLPVPESNDPDVIRRVAAEAAEMFRPVDLESGITVLPCAGDDVDLGFGSGSGSGSGSEERNSSSYGFGDYEEVSTTMMRLAEGPLMSPPRSYMEDMTPTNVYTEEEMCYEDMSLWSYRY

SEQ ID NO: 2185 - DNA, 1005 bp, Arabidopsis thaliana
  G2535  Predicted polypeptide sequence is paralogous to G961
atgaacatatcagtaaacggacagtcacaagtacctcctggctttaggtttcacccaaccgaggaagagctcttgaagtattacctccgcaagaaaatctctaacatcaagatcgatctcgatgttattcctgacattgatctcaacaagctcgagccttgggatattcaagagatgtgtaagattggaacgacgccgcaaaacgattggtacttttatagccataaggacaagaagtatcccaccgggactagaaccaacagagccaccacggtcggattttggaaagcgacgggacgtgacaagaccatatataccaatggtgatagaatcgggatgcgaaagacgcttgtcttctacaaaggtcgagcccctcatggtcagaaatccgattggatcatgcacgaatatagactcgacgagagtgtattaatctcctcgtgtggcgatcatgacgtcaacgtagaaacgtgtgatgtcataggaagtgacgaaggatgggtggtgtgtcgtgttttcaagaaaaataacctttgcaaaaacatgattagtagtagcccggcgagttcggtgaaaacgccgtcgttcaatgaggagactatcgagcaacttctcgaagttatggggcaatcttgtaaaggagagatagttttagaccctttcttaaaactccctaacctcgaatgccataacaacaccaccatcacgagttatcagtggttaatcgacgaccaagtcaacaactgccacgtcagcaaagttatggatcccagcttcatcactagctgggccgctttggatcggctcgttgcctcacagttaaatgggcccaactcgtattcaataccagccgttaatgagacttcacaatcaccgtatcatggactgaaccggtccggttgtaataccggtttaacaccagattactatataccggagattgatttatggaacgaggcagatttcgcgagaacgacatgccacttgttgaacggtagtggataa

SEQ ID NO: 2186 - protein, 334 aa, Arabidopsis thaliana
  G2535  Paralogous to G961
MNISVNGQSQVPPGFRFHPTEEELLKYYLRKKISNIKIDLDVIPDIDLNKLEPWDIQEMCKIGTTPQNDWYFYSHKDKKYPTGTRTNRATTVGFWKATGRDKTIYTNGDRIGMRKTLVFYKGRAPHGQKSDWIMHEYRLDESVLISSCGDHDVNVETCDVIGSDEGWVVCRVFKKNNLCKNMISSSPASSVKTPSFNEETIEQLLEVMGQSCKGEIVLDPFLKLPNLECHNNTTITSYQWLIDDQVNNCHVSKVMDPSFITSWAALDRLVASQLNGPNSYSIPAVNETSQSPYHGLNRSGCNTGLTPDYYIPEIDLWNEADFARTTCHLLNGSG

SEQ ID NO: 2187 - DNA, 876 bp, Arabidopsis thaliana
  G2545  Predicted polypeptide sequence is paralogous to G427
atgcaagaagcggcactaggtatgatgggagccaccgtaggcggagacggagacaccgcggtcgtggcggagcagaatagacagttgaaaggtgagatagcgacacatccgatgtatgagcaattattagccgcacacgtggcgtgtttaagagtagctactccaatagatcaacttccgatcattgaagctcagctttctcaatctcatcatcttctccgttcttacgcttccacggccgttggataccatcatgatcgtcacgagctcgataatttcttggcacaatatgtaatggtgttgtgtagcttcaaagaacagctgcaacagcacgtgagggttcatgccgtcgaagctgttatggcttgccgtgaaattgagaacaaccttcattctcttacaggagcaactttaggagaagggtcgggtgcgactatgtcggaggatgaggatgatcttccgatggatttctcgtcagataattccggcgttgattttagcggcggccacgatatgacgggatttggtccgttgctaccgactgaatcggaaagatcccttatggaaagagtcagacaagaactcaaactagaactcaaacagggttttaaatcgagaatcgaagatgtaagagaagagataatgaggaagagaagggctgggaaattgccaggagacacaactactgtcttgaaaaattggtggcaacaacattgcaaatggccttaccctacggaagatgacaaggcaaaattggtggaggagacaggattgcagttgaagcaaatcaacaattggttcattaaccaacgcaagaggaattggcacaacaactctcactccctcacttccttgaagtccaagcgcaaacactaa

SEQ ID NO: 2188 - protein, 291 aa, Arabidopsis thaliana
  G2545  Paralogous to G427
MQEAALGMMGATVGGDGDTAVVAEQNRQLKGEIATHPMYEQLLAAHVACLRVATPIDQLPIIEAQLSQSHHLLRSYASTAVGYHHDRHELDNFLAQYVMVLCSFKEQLQQHVRVHAVEAVMACREIENNLHSLTGATLGEGSGATMSEDEDDLPMDFSSDNSGVDFSGGHDMTGFGPLLPTESERSLMERVRQELKLELKQGFKSRIEDVREEIMRKRRAGKLPGDTTTVLKNWWQQHCKWPYPTEDDKAKLVEETGLQLKQINNWFINQRKRNWHNNSHSLTSLKSKRKH

SEQ ID NO: 2189 - DNA, 492 bp, Arabidopsis thaliana
  G2631  Predicted polypeptide sequence is paralogous to G484
atggatccgatggatatagttggaaaatcaaaggaagatgcttcgcttccgaaagctaccatgacgaaaattataaaggagatgttacccgcagatgttcgtgttgctagagatgctcaagatctattgattgagtgttgtgtagagttcataaatcttatatcgtcggagtcgaatgaagtgtgtaacaaagaggataaacgaacaatagcccctgagcacgtactcaaagctttacaggttcttggctttggggaatacgtagaagaagtttatgccgcgtatgagcaacataaatatgaaaccatgcaggattcgcagagaagtgtgaagatgaatagcggagcagagatgacggaagaagaggcggcagcggaacaacagaggatgtttgcagaagctcgagcaagaatgaatggaggtgttacagttcctcaaccagagcaactagaagaaccccaacaacaacaacaaacaagtctacaaagctaa

SEQ ID NO: 2190 - protein, 163 aa, Arabidopsis thaliana
  G2631  Paralogous to G484
MDPMDIVGKSKEDASLPKATMTKIIKEMLPADVRVARDAQDLLIECCVEFINLISSESNEVCNKEDKRTIAPEHVLKALQVLGFGEYVEEVYAAYEQHKYETMQDSQRSVKMNSGAEMTEEEAAAEQQRMFAEARARMNGGVTVPQPEQLEEPQQQQQTSLQS

SEQ ID NO: 2191 - DNA, 474 bp, Arabidopsis thaliana
  G2718  Predicted polypeptide sequence is paralogous to G226, G682
atgaatacgcagcgtaagtcgaagcatcttaagaccaatccaaccattgttgcctcttcttctgaaggtaacaactttctccgctatctcatgatctccatccactatacggtgtcgtttgattttactcttttttttttttgaaataataataaatgtgaaatttggatgatgacgtgggacagaagtgagcagtcttgagtgggaagaaatagcaatggctcaggaagaagaggatttgatttgcaggatgtataagcttgtcggtgaaaggtttttcatgttttctcttattccttaacattttttttggttaaatctttcaatatatgtgattttaataagggaattgaagattagtttgtttgtttgtaaaggtgggatttaatagctgggaggattccaggaagaacagcagaagagattgagaggttttgggtgatgaagaatcatcgaagatctcaattacgttga

SEQ ID NO: 2192 - protein, 83 aa, Arabidopsis thaliana
  G2718  Paralogous to G226, G682
MNTQRKSKHLKTNPTIVASSSEEVSSLEWEEIAMAQEEEDLICRMYKLVGERWDLIAGRIPGRTAEEIERFWVMKNHRRSQLR

SEQ ID NO: 2193 - DNA, 1144 bp, Arabidopsis thaliana
  G2776  Predicted polypeptide sequence is paralogous to G1652
actagttctccacaaatctctcttctctctctctcttctcctagaagctgattttcagaggcaacagcaatgagtatcttatccacaagatggttttctgagcaggaaatagaagaaaatagcataattcaacagtttcacatgaactcaatagtgggagaggtccaagaagctcaatacatttttccacactctttcacgaccaacaatgatccctcttatgatgatttgatcgaaatgaaaccaccaaagatccttgagacaacttacatatcaccttcttctcatcttcctccaaattcaaagccccatcatattcaccgtcattcttcctcaagaattctctctttcgaagattatggttcaaatgatatggaacacgagtactctcccacctacctaaactcaatctttagcccaaaattagaggctcaagtgcaaccacaccagaagagtgatgagtttaatcgaaaagggaccaagagggctcaaccgttttcaagaaaccaatccaatgctcaggatcacataatagccgaaagaaaacgtagagagaagcttactcaaagattcgtagctctttccgctctagttcctggccttaaaaagatggacaaggcttctgtgttgggagatgcattaaagcatataaagtatctccaagaaagagtgggagagttggaggaacagaagaaagaaagaagattggaatcaatggttcttgtgaagaagtctaagctgatcttggacgataataatcaatcattctcttcttcttgtgaagatggcttctcggacttggatcttcccgagatcgaggtaagattctcggatgaagatgttctaatcaagatcctttgcgagaagcaaaagggtcatcttgccaagattatggccgagattgagaaacttcatatcttgataactaattcaagtgtattgaattttggaccaactcttgatatcaccattatagctaagaaggagagtgatttcgacatgacactcatggatgttgtaaagagcttaaggtctgctttgtcgaatttcatatgattgtattaactttcatgcttctcgtcaatttctactgtgggagatcttgttgaacacatggacgaaacataagtggtttgccatgaaa

SEQ ID NO: 2194 - protein, 328 aa, Arabidopsis thaliana
  G2776  Paralogous to G1652
MSILSTRWFSEQEIEENSIIQQFHMNSIVGEVQEAQYIFPHSFTTNNDPSYDDLIEMKPPKILETTYISPSSHLPPNSKPHHIHRHSSSRILSFEDYGSNDMEHEYSPTYLNSIFSPKLEAQVQPHQKSDEFNRKGTKRAQPFSRNQSNAQDHIIAERKRREKLTQRFVALSALVPGLKKMDKASVLGDALKHIKYLQERVGELEEQKKERRLESMVLVKKSKLILDDNNQSFSSSCEDGFSDLDLPEIEVRFSDEDVLIKILCEKQKGHLAKIMAEIEKLHILITNSSVLNFGPTLDITIIAKKESDFDMTLMDVVKSLRSALSNFI

SEQ ID NO: 2195 - DNA, 735 bp, Arabidopsis thaliana
  G2826  Predicted polypeptide sequence is paralogous to G361, G362
atggaggagctggattttagttcaaaaacaacaacttctcgtctaaagctatttggatttagtgttgatggagaagaagatttctccgatcaatcagtcaaaactaacctatcttctgtatcaccggaacgtggcgagtttccggcaggatcttccggaagaagtggcggtggtgtacgaagccgaggcggaggaggaggaggaggagaacgtaagtatgagtgtcagtattgttgtagagagtttggtaactcacaagccttaggtggtcaccaaaacgctcacaagaaagagcgtcaacagcttaaacgtgctcagcttcaagctacacgaaacgcagccgcaaatttctcaaacgctggatcagcgtctcagtttttaaggaatcctatagtctctgcttttgctcctccgcctcatcttttatcatcatccgccgtgcctcagcctatgggaggtccttggatgtatcttccacgtgtttctccatctcaacttcacgtgtctcatggctgcgtcatccaagatggttcgggtggtgcgggtgctggtgggttctcgtacgagtatggggctcgtgattcagggtttggagtagttggggctcagatgagacatgttcaggcccatgggccgagaccatcggttaatgggttttcaagagaagtaggaactacttttgatgatggtttagggttggatttgcatctcagtcttgcacctgctggtcattga

SEQ ID NO: 2196 - protein, 244 aa, Arabidopsis thaliana
  G2826  Paralogous to G361, G362
MEELDFSSKTTTSRLKLFGFSVDGEEDFSDQSVKTNLSSVSPERGEFPAGSSGRSGGGVRSRGGGGGGGERKYECQYCCREFGNSQALGGHQNAHKKERQQLKRAQLQATRNAAANFSNAGSASQFLRNPIVSAFAPPPHLLSSSAVPQPMGGPWMYLPRVSPSQLHVSHGCVIQDGSGGAGAGGFSYEYGARDSGFGVVGAQMRHVQAHGPRPSVNGFSREVGTTFDDGLGLDLHLSLAPAGH

SEQ ID NO: 2197 - DNA, 998 bp, Arabidopsis thaliana
  G2838  Predicted polypeptide sequence is paralogous to G361, G362
cgggaattaaatgcaagaaacatagaggagaccgtacttcgaagttgcaaatttaacactaagttgaagaatctagaaatagaaagccaaaatcttcctttacttcaactctacaatttcaatcttttctctgtacttagccatccagagtcataaccaccactatattaaaatgaagacttatgatttcatgaacgtcaactctttctctcctaaggaaagacccattcgcctctttggcttcgagtttggagcttctcatgaagaatctgagtccaaagacaattacaacgagaacaatgaaagcatcaaagacgataacaaagaaaaaagattcaagtgccactattgtttccggaacttccctacttcacaagccctaggcggccatcaaaacgctcacaagagagaacgtcaacaaactaaacgcttcaacctccattcaaacgcagccgctttcttccaccgccaacaaaaccacattgctgcttctaggctctacgaggatcgctatagccttgaagctgttcaaatcaacgacgcgagattagggttatgtcgtatgtataactcatctgcgagttttaatcgtgaccgttcatcttattataatagatatattccttggttcatcggtgatcaccagactagaccaacgtatgtcggtggtggtagcagcagccatggtctgttttacgagtccaagaagaatgtaccggaccacgtgagtttggatctacgcctctagttccattcttttagtatctctctctagctagttcttaaaaaaaaaaaaagagagactagttttttttccttctttcaaatactttttattttattttagtctacttgattaattatgaatttatgatagtgtatccccgtagatatcatgttatattaacagttaaacaattttatggagatgaactttaacttcagatagtttctttctgagatttaaagtcttaaatattatcgacgcattccaatct

SEQ ID NO: 2198 - protein, 191 aa, Arabidopsis thaliana
  G2838  Paralogous to G361, G362
MKTYDFMNVNSFSPKERPIRLFGFEFGASHEESESKDNYNENNESIKDDNKEKRFKCHYCFRNFPTSQALGGHQNAHKRERQQTKRFNLHSNAAAFFHRQQNHIAASRLYEDRYSLEAVQINDARLGLCRMYNSSASFNRDRSSYYNRYIPWFIGDHQTRPTYVGGGSSSHGLFYESKKNVPDHVSLDLRL

SEQ ID NO: 2199 - DNA, 495 bp, Arabidopsis thaliana
  G2839  Predicted polypeptide sequence is paralogous to G353, G354
atggttgcgagaagtgaggaagttgagatagtggaagatacggcggcgaaatgtttgatgttgttatcaagagttggagaatgcggcggaggaggagagaaacgagttttccgatgcaagacttgtcttaaagagttttcgtcgtttcaagctttgggaggtcatcgtgcaagccacaagaaactcattaacagtagcgatccatcacttcttggatccttgtctaacaagaaaactaaaacggcgacgtctcatccttgtccgatatgtggcgtggagtttccgatggggcaagctcttggtggtcacatgaggagacataggagtgagaaagcctcaccaggcacgttggttacacgttcttttttaccggagacgacgacggtgacgactttgaaaaaatcgagtagtgggaagagagtggcttgtttggacttagattcgatggagagtttagtcaattggaagttggagttgggaagaacgatttcttga

SEQ ID NO: 2200 - protein, 164 aa, Arabidopsis thaliana
  G2839  Paralogous to G353, G354
MVARSEEVEIVEDTAAKCLMLLSRVGECGGGGEKRVFRCKTCLKEFSSFQALGGHRASHKKLINSSDPSLLGSLSNKKTKTATSHPCPICGVEFPMGQALGGHMRRHRSEKASPGTLVTRSFLPETTTVTTLKKSSSGKRVACLDLDSMESLVNWKLELGRTIS

SEQ ID NO: 2201 - DNA, 2693 bp, Arabidopsis thaliana
  G3010  Predicted polypeptide sequence is paralogous to G987
catcttctttctagtctctctctctctcttcaccgcgtacacagtaacacagaccctttttccctcttactcaaggttcttctttgtcatcttgttgccgaatccacaaagaggagaataaagattcgacctttattagatattaacgactctggatttttgggtttttggagttggatccacatgggttcttatccggatggattccctggatccatggacgagttggatttcaataaggactttgatttgcctccctcctcaaaccaaaccttaggtttagctaatgggttctatttagatgacttagatttctcatccttggatcctccagaggcatatccctcccagaacaacaacaacaacaacatcaacaacaaagctgtagcaggagatctgttatcatcttcatctgatgacgctgatttctctgattctgttttgaagtatataagccaagttcttatggaagaggatatggaagagaagccttgtatgtttcatgacgctttggctcttcaagctgctgagaaatctctctatgaggctcttggtgagaaatacccttcttcgtcttctgcttcttctgtggatcatcctgagagattggctagtgatagccctgacggttcttgttcaggtggtgcttttagtgattacgctagcaccactaccactacttcctctgattctcactggagtgttgatggtttggagaatagaccttcttggttacatacacctatgccgagtaattttgttttccagtctacttctaggtccaacagtgtcaccggtggtggtggtggtggtaatagtgcggtttacggttcaggttttggcgatgatttggtttcgaatatgtttaaagatgatgaattggctatgcagttcaagaaaggggttgaggaagctagtaagttccttcctaagtcttctcagctctttattgatgtggatagttacatccctatgaattctggttccaaggaaaatggttctgaggtttttgttaagacggagaagaaagatgagacagagcatcatcatcatcatagctatgctcctcctcccaacagattaactggtaagaaaagccattggcgcgacgaagatgaagatttcgttgaagaaagaagtaacaagcaatcagctgtttatgttgaggaaagcgagctttctgaaatgtttgataagatcttggtatgtggccctgggaaacctgtatgcattcttaaccagaactttcctacagaatccgctaaagtcgtgaccgcacagtcaaatggagcaaagattcgtgggaagaaatcaacttctactagtcatagtaacgattctaagaaagaaactgctgatttgaggactcttttggtgttatgtgcacaagctgtatcagtggatgatcgtagaaccgccaacgaaatgctaaggcagatacgagagcattcttcgcctctaggcaatggttcagagcggttggctcattattttgcaaatagtcttgaagcacgcttagctgggaccggtacacagatctacaccgctttatcttcgaagaaaacgtctgcagcagacatgttgaaggcttaccagacatacatgtcggtctgccctttcaagaaagctgctatcatatttgctaaccacagcatgatgcgtttcactgcaaacgccaacacgatccacataatagatttcggaatatcttacggttttcagtggcctgctctgattcatcgcctctcgctcagcagacctggtggttcgcctaagcttcgaattaccggtatagagcttcctcagcgcggttttagaccagcggaagagttcaggagacaggtcatcgcttggctcgatactgtcagcgacacaatgttccgtttgagtacaacgcaattgctcagaaatggggaaacgatccaagtcgaagacttaaagcttcgacaaggagagtatgtggttgtgaactctttgttccgtttcaggaaccttctagatgagaccgttctggtaaacagcccgagagatgcagttttgaagctgataagaaaaataaacccgaatgtcttcattccagcgatcttaagcgggaattacaacgcgccattctttgtcacgaggttcagagaagcgttgtttcattactcggctgtgtttgatatgtgtgactcgaagctagctagggaagacgagatgaggctgatgtatgagaaagagttttatgggagagagattgtgaatgttgtggcttgtgaaggaacagagagagtggagagaccagagacatataagcagtggcaggcgagactgatccgagccggatttagacagcttccgcttgagaaggaactgatgcagaatctgaagttgaaaatcgaaaacgggtacgataaaaacttcgatgttgatcaaaacggtaactggttacttcaagggtggaaaggtagaatcgtgtatgcttcatctctatgggttccttcgtcttcatagatgttgtttcttacgttctaagcgactgggatttatgtagggcttttctgttgatagtctctcgccaacacgagtggattaagttcagagttagggttcttgaacactagaatgttgttatattatgcttgtgacatagcgtgtgtaagagtgtagcctaagagatatagtactcattgcatgatcttttgctatatgtt

SEQ ID NO: 2202 - protein, 769 aa, Arabidopsis thaliana
  G3010  Paralogous to G987
MGSYPDGFPGSMDELDFNKDFDLPPSSNQTLGLANGFYLDDLDFSSLDPPEAYPSQNNNNNNINNKAVAGDLLSSSSDDADFSDSVLKYISQVLMEEDMEEKPCMFHDALALQAAEKSLYEALGEKYPSSSSASSVDHPERLASDSPDGSCSGGAFSDYASTTTTTSSDSHWSVDGLENRPSWLHTPMPSNFVFQSTSRSNSVTGGGGGGNSAVYGSGFGDDLVSNMFKDDELAMQFKKGVEEASKFLPKSSQLFIDVDSYIPMNSGSKENGSEVFVKTEKKDETEHHHHHSYAPPPNRLTGKKSHWRDEDEDFVEERSNKQSAVYVEESELSEMFDKILVCGPGKPVCILNQNFPTESAKVVTAQSNGAKIRGKKSTSTSHSNDSKKETADLRTLLVLCAQAVSVDDRRTANEMLRQIREHSSPLGNGSERLAHYFANSLEARLAGTGTQIYTALSSKKTSAADMLKAYQTYMSVCPFKKAAIIFANHSMMRFTANANTIHIIDFGISYGFQWPALIHRLSLSRPGGSPKLRITGIELPQRGFRPAEEFRRQVIAWLDTVSDTMFRLSTTQLLRNGETIQVEDLKLRQGEYVVVNSLFRFRNLLDETVLVNSPRDAVLKLIRKINPNVFIPAILSGNYNAPFFVTRFREALFHYSAVFDMCDSKLAREDEMRLMYEKEFYGREIVNVVACEGTERVERPETYKQWQARLIRAGFRQLPLEKELMQNLKLKIENGYDKNFDVDQNGNWLLQGWKGRIVYASSLWVPSSS

SEQ ID NO: 2203 - DNA, 632 bp, Brassica napus
  bnCBF1
cacccgatataccggggagttcgtctgagaaagtcaggtaagtgggtgtgtgaagtgagggaaccaaacaagaaatctagaatttggcttggaactttcaaaacagctgagatggcagctcgtgctcacgacgtcgctgccctagccctccgtggaagaggcgcctgcctcaattatgcggactcggcttggcggctccgcatcccggagacaacctgccacaaggatatccagaaggctgctgctgaagccgcattggcttttgaggctgagaaaagtgatgtgacgatgcaaaatggccagaacatggaggagacgacggcggtggcttctcaggctgaagtgaatgacacgacgacagaacatggcatgaacatggaggaggcaacggcagtggcttctcaggctgaggtgaatgacacgacgacggatcatggcgtagacatggaggagacaatggtggaggctgtttttactggggaacaaagtgaagggtttaacatggcgaaggagtcgacggtggaggctgctgttgttacggaggaaccgagcaaaggatcttacatggacgaggagtggatgctcgagatgccgaccttgttggctgatatggcagaagggatgctcctgcc

SEQ ID NO: 2204 - protein, 208 aa, Brassica napus
  bnCBF1
HPIYRGVRLRKSGKWVCEVREPNKKSRIWLGTFKTAEMAARAHDVAALALRGRGACLNYADSAWRLRIPETTCHKDIQKAAAEAALAFEAEKSDVTMQNGQNMEETTAVASQAEVNDTTTEHGMNMEEATAVASQAEVNDTTTDHGVDMEETMVEAVFTGEQSEGFNMAKESTVEAAVVTEEPSKGSYMDEEWMLEMPTLLADMAEGM

SEQ ID NO: 2205 - DNA, 20 bp, artificial sequence
  Mol 368 reverse primer
  misc_feature (6)..(6): n is a, c, g, or t
  misc_feature (15)..(15): n is a, c, g, or t
  misc_feature (18)..(18): n is a, c, g, or t
cayccnathtaymgnggngt

SEQ ID NO: 2206 - DNA, 21 bp, artificial sequence
  Mol 378 forward primer
  misc_feature (3)..(3): n is a, c, g, or t
  misc_feature (6)..(6): n is a, c, g, or t
  misc_feature (12)..(12): n is a, c, g, or t
  misc_feature (18)..(18): n is a, c, g, or t
ggnarnarcatnccytcngcc

SEQ ID NO: 2207 - DNA, 759 bp, Arabidopsis thaliana
  G3
gtttgtcttttatcaatggaaagagaacaagaagagtctacgatgagaaagagaaggcagccacctcaagaagaagtgcctaaccacgtggctacaaggaagccgtacagagggatacggaggaggaagtggggcaagtgggtggctgagattcgtgagcctaacaaacgctcacggctttggcttggctcttacacaaccgatatcgccgccgctagagcctacgacgtggccgtcttctacctccgtggcccctccgcacgtctcaacttccctgatcttctcttgcaagaagaggaccatctctcagccgccaccaccgctgacatgcccgcagctcttataagggaaaaagcggcggaggtcggcgccagagtcgacgctcttctagcttctgccgctccttcgatggctcactccactccgccggtaataaaacccgacttgaatcaaatacccgaatccggagatatatagtcaatttatatacatgtagtttgttttgtttgattagaagattacatttacatacaagatacacatagatactggaaaatataggtatgtatacattcataaattatcttatgtatcaaagaattttatagattctgattagctttttgtttttgtttttgataagaactctgattagttgtccggagacaaaaccggctaagagcaatccatgagaagctagcgagtgttttttagttcaagttgtaatataaatgcatattaattctttagtaattttgt

SEQ ID NO: 2208 - protein, 153 aa, Arabidopsis thaliana
  G3
MEREQEESTMRKRRQPPQEEVPNHVATRKPYRGIRRRKWGKWVAEIREPNKRSRLWLGSYTTDIAAARAYDVAVFYLRGPSARLNFPDLLLQEEDHLSAATTADMPAALIREKAAEVGARVDALLASAAPSMAHSTPPVIKPDLNQIPESGDI

SEQ ID NO: 2209 - DNA, 1650 bp, Arabidopsis thaliana
  G20
ctctcactctctttttctctctctttacttctactgtatcaagaagctccgttttgcttagccatagtgcgtctagggtttggttggtgggaagaaggttccgatcatggcgtcggtgtcgtcgtcggatcaaggacctaagacagaagcaggatgtagcggcggaggaggaggagagagctcggagacagtggcggcgagtgatcagatgttgttgtatagaggttttaagaaggcgaagaaggagagaggttgtacagctaaggagcgtattagtaaaatgcctccgtgcactgctgggaaaaggagttccatataccggggagtcaccagacatagatggacaggtcgttatgaagctcacctttgggataagagtacctggaaccaaaaccagaacaagaagggaaaacaagtttatctaggagcatatgatgatgaagaggctgctgctagagcttacgaccttgctgccttaaaatattggggtcctgggacacttataaattttccggtgactgattataccagggatttagaagaaatgcaaaatctctcaagggaagaataccttgcatctttacgtagatatccctttggcagaaaaagcagcggtttctctaggggaatagcgaaatatcgtggacttcaaagccgatgggacgcatcagccagtcgtatgcctggacctgaatacttcagtaacattcattacggggcaggtgatgatcgtggaacagaaggtgactttctaggtagcttttgtctggaaagaaagattgatctaacaggatacataaagtggtggggagccaacaagaaccgtcaaccagaatcttcatcaaaagcatcagaggatgcaaacgtcgaagatgctggtactgagcttaaaacactggaacacacatcccatgcaacagaaccatacaaggcgccaaaccttggcgtcctttgtggaactcagagaaaagaaaaagaaatatcatcaccatcaagctcttctgctttaagcatcttgtctcagtcgcctgccttcaagagcctagaggagaaagtgttgaagatccaagaaagctgcaataatgaaaacgatgagaatgcaaaccgtaacatcatcaatatggagaagaataacggcaaggcaatagagaaaccagttgtgagtcatggagttgctttaggcggtgctgctgctttgtctcttcagaaaagcatgtacccacttacctctctcttaacggctccattgctcaccaactacaatacattggatcctcttgcagaccctattctctggacaccatttcttccttcaggatcctctcttacttcagaggtgacaaagacagagaccagctgttccacgtacagctacctcccacaagagaaatgagccgttccctttagactttatgtatgtcagattctccttttttgagatgaattcgtcgacttgacatctctttgtctcttttatggagaaaaagttgggaaaagtgtgacaatggtctgaagcaggaatgtacaggttttgttagtggttgtgtttttttttttccagtgtggaatatagaatcatgatattttgtgtaaaacagaaaaaagttatcattatagtatagaagtttgctcttaaaaaaaaaaaaaaaa

SEQ ID NO: 2210 - protein, 428 aa, Arabidopsis thaliana
  G20
MASVSSSDQGPKTEAGCSGGGGGESSETVAASDQMLLYRGFKKAKKERGCTAKERISKMPPCTAGKRSSIYRGVTRHRWTGRYEAHLWDKSTWNQNQNKKGKQVYLGAYDDEEAAARAYDLAALKYWGPGTLINFPVTDYTRDLEEMQNLSREEYLASLRRYPFGRKSSGFSRGIAKYRGLQSRWDASASRMPGPEYFSNIHYGAGDDRGTEGDFLGSFCLERKIDLTGYIKWWGANKNRQPESSSKASEDANVEDAGTELKTLEHTSHATEPYKAPNLGVLCGTQRKEKEISSPSSSSALSILSQSPAFKSLEEKVLKIQESCNNENDENANRNIINMEKNNGKAIEKPVVSHGVALGGAAALSLQKSMYPLTSLLTAPLLTNYNTLDPLADPILWTPFLPSGSSLTSEVTKTETSCSTYSYLPQEK

SEQ ID NO: 2211 - DNA, 1003 bp, Arabidopsis thaliana
  G21
tgtggaggaatattaatacagcccacttcacatctatttttgtgcaaccatctctctaaagcttcttctctcataacaatggcaagacaaatcaacatagagagtagtgtttctcaagttacctttatctcctccgccatccccgccgtatcttcctcctcctccatcaccgcttccgcctcattgtcctcttcacctactacatcttcctcttcttcgtcatcaacaaattctaacttcattgaggaagacaactctaaaagaaaagcatctcgaagatcattgtcatcgttagtctccgttgaagacgatgatgatcaaaacggtggaggtgggaaacggcgaaagaccaacggtggagataaacatccgacgtatagaggagtgaggatgaggagttggggaaaatgggtgtcggagattagagagccgagaaagaaatcaagaatctggctcgggacttatccaacggctgagatggcagctcgagctcatgacgtagcggctttagccattaaaggtacaacggcttacctcaattttcccaagttagccggcgagcttcctcgtccagtcacaaattctcctaaagacattcaagccgccgcctctttagcggccgttaactggcaagattcggtcaacgatgtgagtaattctgaagtggctgaaatagttgaagccgagccgagtcgagccgtggtggctcagttgttttcttcggacacaagcacgacgacgacgactcagagtcaagagtattcggaagcttcgtgtgcttcgacttcggcgtgtacggacaaagacagtgaggaagagaagctgtttgatttgccggatttgtttaccgatgagaatgagatgatgatacgaaacgatgcgttttgctactactcgtccacgtggcagctttgtggagccgatgctgggtttcggcttgaagagccgttttttctatctgaatgactaaagtacccctctcgagagagctctcactaacact

SEQ ID NO: 2212 - protein, 295 aa, Arabidopsis thaliana
  G21
MARQINIESSVSQVTFISSAIPAVSSSSSITASASLSSSPTTSSSSSSSTNSNFIEEDNSKRKASRRSLSSLVSVEDDDDQNGGGGKRRKTNGGDKHPTYRGVRMRSWGKWVSEIREPRKKSRIWLGTYPTAEMAARAHDVAALAIKGTTAYLNFPKLAGELPRPVTNSPKDIQAAASLAAVNWQDSVNDVSNSEVAEIVEAEPSRAVVAQLFSSDTSTTTTTQSQEYSEASCASTSACTDKDSEEEKLFDLPDLFTDENEMMIRNDAFCYYSSTWQLCGADAGFRLEEPFFLSE

SEQ ID NO: 2213 - DNA, 970 bp, Arabidopsis thaliana
  G23
tatcaaacgagagtacaaaagatgacgtcactcaacagctctgcatcaccaacatcatcgtcatcagaccaatctgatgcaactactacaacaagcacccacttgtctgaagaagaagctccacccagaaacaacaacacaagaaagagaaggagagattcttcttctgcttcttcatcttcttcaatgcaacatcctgtttacagaggtgtgcggatgagaagttggggcaaatgggtctccgagatccgacaacctcgtaagaaaactcgtatttggctcggcacttttgtcaccgctgatatggctgctcgtgctcacgacgtcgctgctctcaccatcaaaggctcctccgccgtcttaaatttccctgagcttgcttctctcttccctcgtccggcgtcatcatcgccgcatgatatccagacagccgccgcagaagccgccgccatggtggtcgaagaaaaactgttagagaaggatgaggctccggaggccccaccttcgtcggaatcttcttacgtggcggcggagtcagaggatgaggagaggttggagaaaattgtggagctgcctaacattgaagaaggaagttatgacgagagtgtgacatcacgtgctgatctggcttattctgagccgttcgattgttgggtgtatcctccggttatggatttttatgaagaaatatcggagtttaatttcgtggaattgtggagctttaatcactaattaagttaggaaagtgcattatattgcaatattgcatcatagataacatttgtatttcttttctttttgtacggatacgtagcatatgctactatactagggctagtgtaccaaatattgtaaaatatacttattaatatttatgtaaatgtgtaatatatataacatacaattattgtaagtttggaaattggaaactatcgttacgcaatgttcttgtaaaaaaaaaaaaaaaaaa

SEQ ID NO: 2214 - protein, 236 aa, Arabidopsis thaliana
  G23
MTSLNSSASPTSSSSDQSDATTTTSTHLSEEEAPPRNNNTRKRRRDSSSASSSSSMQHPVYRGVRMRSWGKWVSEIRQPRKKTRIWLGTFVTADMAARAHDVAALTIKGSSAVLNFPELASLFPRPASSSPHDIQTAAAEAAAMVVEEKLLEKDEAPEAPPSSESSYVAAESEDEERLEKIVELPNIEEGSYDESVTSRADLAYSEPFDCWVYPPVMDFYEEISEFNFVELWSFNH

SEQ ID NO: 2215 - DNA, 1084 bp, Arabidopsis thaliana
  G26
ttggcttgtacccaaacccatctttgacttcaaaaataaaataaaaataatcataattgacatcatcggataatgcatagcgggaagagacctctatcaccagaatcaatggccggaaatagagaagagaaaaaagagttgtgttgttgctcaactttgtcggaatctgatgtgtctgattttgtctctgaactcactggtcaacccatcccatcatccattgatgatcaatcttcgtcgcttactcttcaagaaaaaagtaactcgaggcaacgaaactacagaggcgtgaggcaaagaccgtggggaaaatgggcggctgagattcgtgacccgaacaaggcagctcgtgtgtggcttgggacgttcgacactgcagaagaagccgccttagcgtatgataaagctgcatttgagtttagaggtcacaaggccaagcttaacttccccgagcatattcgtgtcaaccctactcaactctatccatcgcccgctacttcccatgatcgcattatcgtgacaccacctagtccacctccaccaattgctcctgacatacttcttgatcaatatggccactttcaatctcgaagtagtgattccagtgccaacttgtccatgaatatgctgtcttcttcgtcttcatctttgaatcatcaagggctaagaccaaatttggaggatggtgaaaacgtgaagaacattagtatccacaaacgacgaaaataacatgttaatggcataaatatctcttcgtccaagttatcaaacgcattgacctccggctttgatcattttaggcgcttaatctctttacgacttcattttggtagtctttaaagagtctatggagtggatttagctaggaatcaggccttatggatgaaaaatatataaattttgaacatgactatgcaagaatgggatgaagactacttagcttggaaaacgtcctgataggtcatgacgactatatccacagaagatgaccgacggagacaacaacatgcctcacctgatcgaccgatcaaatgagataatgtgttgaccggaccggtcggatcaggttgggtcgagtatatca

SEQ ID NO: 2216 - protein, 218 aa, Arabidopsis thaliana
  G26
MHSGKRPLSPESMAGNREEKKELCCCSTLSESDVSDFVSELTGQPIPSSIDDQSSSLTLQEKSNSRQRNYRGVRQRPWGKWAAEIRDPNKAARVWLGTFDTAEEAALAYDKAAFEFRGHKAKLNFPEHIRVNPTQLYPSPATSHDRIIVTPPSPPPPIAPDILLDQYGHFQSRSSDSSANLSMNMLSSSSSSLNHQGLRPNLEDGENVKNISIHKRRK

SEQ ID NO: 2217 - DNA, 881 bp, Arabidopsis thaliana
  G27
caaaataccaaaaacaaaacattttttttaatcttcccaccaatttttttctctttctctcgttacattaaattatctttagatgcaagactcttcctctcacgaatcgcaacgtaacctccggtcaccggtgccggagaaaaccggaaagagttctaagactaaaaatgagcaaaaaggtgtttctaaacaaccaaattttcgtggggtcagaatgagacaatggggaaaatgggtgtctgaaattagagaaccaagaaagaaatcaagaatatggctcggtactttctctacgccggagatggcggcgcgtgcacacgacgtggcggctttagccatcaaaggtggctctgcccaccttaatttcccggagctagcttaccatttgccgagaccggctagcgcggaccctaaagacattcaagaagccgccgccgcagcagctgccgttgactggaaagcaccggagtctccgtctagcaccgtgacgtcatctccagtcgccgacgacgctttctccgatcttcctgatcttttgcttgacgtgaatgatcacaacaaaaacgatggattctgggactcgtttccgtacgaagatcctttcttcttggaaaattactagaaggcaaattcttgccggcgaacggattttccggtggtttcccggtaaataagaagacgatgtcgttttgtaccttttttgtctacgatgggaaatttcttttttttttacgtgtgagtaaaagtttccgaatgtgtgatgtgtaagtaagtacaggttatttaatttcttttttttgtacaaatacgtacgtcattaccaaaaagttttcatttattgtgcttttatcttccaaattcattaaaaaaaaaaaaaaaaa

SEQ ID NO: 2218 - protein, 179 aa, Arabidopsis thaliana
  G27
MQDSSSHESQRNLRSPVPEKTGKSSKTKNEQKGVSKQPNFRGVRMRQWGKWVSEIREPRKKSRIWLGTFSTPEMAARAHDVAALAIKGGSAHLNFPELAYHLPRPASADPKDIQEAAAAAAAVDWKAPESPSSTVTSSPVADDAFSDLPDLLLDVNDHNKNDGFWDSFPYEDPFFLENY

SEQ ID NO: 2219 - DNA, 679 bp, Arabidopsis thaliana
  G31
cttttataagcaatggctccaagacaggcgaacggtagaagcattgccgtgagtgaaggcggcggagggaagacgatgacgatgacgacgatgcggaaggaagtgcactttagaggtgtgaggaagcgtccatggggtagatacgcggcggagatccgtgacccgggaaagaaaacccgggtttggctcgggacattcgacacggcggaggaagctgcaagagcttacgacaccgccgctagagagtttcgtggctccaaagcaaagactaatttccctcttcccggagagtctactacggttaacgacggtggcgagaacgattcttacgtcaaccgtacgacggtgacgacggcgcgtgagatgacgcgtcagagatttccgtttgcatgtcaccgggagcgtaaagtcgtcggtggttatgcttctgctggttttttcttcgatccgtcaagagctgcttcgttaagagcagagctttctcgggtttgtccggttcggtttgatccggttaatatcgagttgagtattggtattcgagaaaccgtaaaagttgaaccgagaagagaactaaacctggatcttaacctagctccaccggtggtggacgtttagatttttttcttcttttcataatttgtattttacattgccggaaaataattaatgttttctttag

SEQ ID NO: 2220 - protein, 200 aa, Arabidopsis thaliana
  G31
MAPRQANGRSIAVSEGGGGKTMTMTTMRKEVHFRGVRKRPWGRYAAEIRDPGKKTRVWLGTFDTAEEAARAYDTAAREFRGSKAKTNFPLPGESTTVNDGGENDSYVNRTTVTTAREMTRQRFPFACHRERKVVGGYASAGFFFDPSRAASLRAELSRVCPVRFDPVNIELSIGIRETVKVEPRRELNLDLNLAPPVVDV

SEQ ID NO: 2221 - DNA, 911 bp, Arabidopsis thaliana
  G32
aacacacattccctctcttccttcaactagaaaaaagatagatatatcggacatttattgatctgtgtatgcataaaggtatagtatcattattagaaagatgaacacaacatcatcaaagagcaagaagaagcaagacgatcaggttggtacaaggtttcttggggtgagaagaaggccttggggaagatacgcagctgagattagagacccaactacgaaggagcgtcactggcttggcactttcgatacggcggaagaagctgccttggcctacgatagagctgctcggtccatgcgtggcacacgtgccagaaccaactttgtttactcagacatgcctccttcctcatccgtcacctccattgtttctcctgacgatcctcctcctcctccacctcctcctgctcctcctagcaatgatcctgtcgattacatgatgatgtttaaccaatactcatccactgactcgccaatgcttcagcctcattgtgatcaagtggacagttacatgtttggtggctctcaatcttcgaattcttattgctattctaatgacagtagtaatgagctgcctcctctcccgagcgacttgtcgaattcgtgttatagccaaccacagtggacctggaccggtgacgactactcgtctgagtacgtacatagtccaatgttcagcagaatgcctccggtttctgactctttccctcaaggtttcaactactttggctcctaattctttctcatcgtccatatttaataccttcctcatttgtaccttttccttcttcttcttttttgggtttatctatgtttcgccgtccttgatctctgcctatgtgatcaaagtgactgtttgtcattagtttttcaataacaagttatcatttgtatcttgaaaaaaaaaaaaa

SEQ ID NO: 2222 - protein, 211 aa, Arabidopsis thaliana
  G32
MNTTSSKSKKKQDDQVGTRFLGVRRRPWGRYAAEIRDPTTKERHWLGTFDTAEEAALAYDRAARSMRGTRARTNFVYSDMPPSSSVTSIVSPDDPPPPPPPPAPPSNDPVDYMMMFNQYSSTDSPMLQPHCDQVDSYMFGGSQSSNSYCYSNDSSNELPPLPSDLSNSCYSQPQWTWTGDDYSSEYVHSPMFSRMPPVSDSFPQGFNYFGS

SEQ ID NO: 2223 - DNA, 933 bp, Arabidopsis thaliana
  G33
attctcccccaaccaaaatatgaccacagaaaaagagaatgtcactacggccgtggccgtgaaagacggcggagaaaagagtaaggaagtgagtgacaagggcgtaaagaagagaaagaatgtaactaaggccctggccgtgaatgacggcggagaaaagagtaaggaagtgcgttacaggggtgtaaggaggagaccatgggggagatatgctgcggagatccgtgatccggtaaagaaaaaacgggtctggctcgggtccttcaacacgggggaggaagccgccagagcctacgactccgctgccataaggtttcgaggatcgaaagctactactaacttccctctaatcggatactatgggatttcttcggcgacgccggtgaacaacaacctttccgagacggtgagtgatggaaatgccaacctccctctcgttggagacgatgggaatgctttggcttctccggtgaacaacaccctttccgaaacggcgcgtgatggaacacttccatcggattgtcacgacatgttatctccgggggtggctgaagcggttgctggatttttcttagatctgcctgaagttattgcgttgaaagaggagcttgatcgagtttgtcctgaccagtttgagtccattgatatggggttgactattggtcctcaaaccgccgtggaagagcctgagacttcctccgccgtggattgtaagctgcgaatggaaccggatcttgacctcaacgcaagtccctaaagattgatctgatgttgttgtccttgaataagtttgttatcttgtcgctcttctgattgtctgtacttctattggttgattcgtgcttttggaggacaaaacaaacatttttttatgtattaaaaaaaggtaattgaactattatcgaaaaaaaaaaaaaaaaaaaaaaaaaaaaa

SEQ ID NO: 2224 - protein, 245 aa, Arabidopsis thaliana
  G33
MTTEKENVTTAVAVKDGGEKSKEVSDKGVKKRKNVTKALAVNDGGEKSKEVRYRGVRRRPWGRYAAEIRDPVKKKRVWLGSFNTGEEAARAYDSAAIRFRGSKATTNFPLIGYYGISSATPVNNNLSETVSDGNANLPLVGDDGNALASPVNNTLSETARDGTLPSDCHDMLSPGVAEAVAGFFLDLPEVIALKEELDRVCPDQFESIDMGLTIGPQTAVEEPETSSAVDCKLRMEPDLDLNASP

SEQ ID NO: 2225 - DNA, 1440 bp, Arabidopsis thaliana
  G38
gaggaaaactcgaaaaagctacacacaagaagaagaagaaaagatacgagcaagaagactaaacacgaaagcgatttatcaactcgaaggaagagactttgattttcaaatttcgtcccctatagattgtgttgtttctgggaaggagatggcagtttatgatcagagtggagatagaaacagaacacaaattgatacatcgaggaaaaggaaatctagaagtagaggtgacggtactactgtggctgagagattaaagagatggaaagagtataacgagaccgtagaagaagtttctaccaagaagaggaaagtacctgcgaaagggtcgaagaagggttgtatgaaaggtaaaggaggaccagagaatagccgatgtagtttcagaggagttaggcaaaggatttggggtaaatgggttgctgagatcagagagcctaatcgaggtagcaggctttggcttggtactttccctactgctcaagaagctgcttctgcttatgatgaggctgctaaagctatgtatggtcctttggctcgtcttaatttccctcggtctgatgcgtctgaggttacgagtacctcaagtcagtctgaggtgtgtactgttgagactcctggttgtgttcatgtgaaaacagaggatccagattgtgaatctaaacccttctccggtggagtggagccgatgtattgtctggagaatggtgcggaagagatgaagagaggtgttaaagcggataagcattggctgagcgagtttgaacataactattggagtgatattctgaaagagaaagagaaacagaaggagcaagggattgtagaaacctgtcagcaacaacagcaggattcgctatctgttgcagactatggttggcccaatgatgtggatcagagtcacttggattcttcagacatgtttgatgtcgatgagcttctacgtgacctaaatggcgacgatgtgtttgcaggcttaaatcaggaccggtacccggggaacagtgttgccaacggttcatacaggcccgagagtcaacaaagtggttttgatccgctacaaagcctcaactacggaatacctccgtttcagctcgagggaaaggatggtaatggattcttcgacgacttgagttacttggatctggagaactaaacaaaacaatatgaagctttttggatttgatatttgccttaatcccacaacgactgttgattctctatccgagttttagtgatatagagaactacagaacacgttttttcttgttataaaggtgaactgtatatatcgaaacagtgatatgacaatagagaagacaactatagtttgttagtctgcttctcttaagttgttctttagatatgttttatgttttgtaacaacaggaatgaataatacacacttgtgaagcttttaaaaaaaaaaaaaaaaaaaaa

SEQ ID NO: 2226 - protein, 335 aa, Arabidopsis thaliana
  G38
MAVYDQSGDRNRTQIDTSRKRKSRSRGDGTTVAERLKRWKEYNETVEEVSTKKRKVPAKGSKKGCMKGKGGPENSRCSFRGVRQRIWGKWVAEIREPNRGSRLWLGTFPTAQEAASAYDEAAKAMYGPLARLNFPRSDASEVTSTSSQSEVCTVETPGCVHVKTEDPDCESKPFSGGVEPMYCLENGAEEMKRGVKADKHWLSEFEHNYWSDILKEKEKQKEQGIVETCQQQQQDSLSVADYGWPNDVDQSHLDSSDMFDVDELLRDLNGDDVFAGLNQDRYPGNSVANGSYRPESQQSGFDPLQSLNYGIPPFQLEGKDGNGFFDDLSYLDLEN

SEQ ID NO: 2227 - DNA, 754 bp, Arabidopsis thaliana
  G39
  misc_feature (677)..(677): n is a, c, g, or t
gtttccacagtccctgtacttgtgcataaaactgtaaaacactactctgaaaattttgcttctgttaggatataatgccaccctctcctcctaaatctccttttattagctcttcactcaaaggagctcatgaagatcgcaaatttaaatgctataggggtgtccgaaagaggtcttggggcaaatgggtgtctgaaatcagagttccaaagactggacgacgaatatggctaggttcatacgatgctccagagaaggcagctagagcctatgatgctgctttgttctgtattaggggtgagaagggagtttacaattttcccactgataaaaagccgcagcttccagaaggttctgtccggcctctgtccaagctcgacatacagacaatagcaacaaactatgcttcatcagttgtgcatgtaccttcccatgccaccacactcccggcaacaacccaggttccctctgaagttcctgcttcctctgatgtttctgcttctactgagattacagagatggtcgatgaatattatctcccaaccgatgcaactgcagaatcaatattctcagttgaagacttacaactggacagtttcctcatgatggacattgattggataaacaatctaatctgatgtgtaacgtcacttgcagtgacatttaatatggtttanctatcagttacctgtctgcttcttgtaagggtatacttggatccttgtctttgaacttgttttatttagcatgcaaa

SEQ ID NO: 2228 - protein, 187 aa, Arabidopsis thaliana
  G39
MPPSPPKSPFISSSLKGAHEDRKFKCYRGVRKRSWGKWVSEIRVPKTGRRIWLGSYDAPEKAARAYDAALFCIRGEKGVYNFPTDKKPQLPEGSVRPLSKLDIQTIATNYASSVVHVPSHATTLPATTQVPSEVPASSDVSASTEITEMVDEYYLPTDATAESIFSVEDLQLDSFLMMDIDWINNLI

SEQ ID NO: 2229 - DNA, 909 bp, Arabidopsis thaliana
  G43
ctcctgtcttgtctaaagaaaaaagagagaggaagaaatggagacttttgaggaaagctctgatttggatgttatacagaaacatctatttgaagacttgatgatccctgatggtttcattgaagattttgtctttgatgatactgcttttgtctccggactctggtctctagaaccctttaacccagttccgaaactggaacctagttcacctgttcttgatccagattcctatgtccaagagattctgcaaatggaagcagaatcatcatcatcatcatcaacaacaacgtcacctgaggttgagactgtctcaaaccggaaaaaaacaaagaggtttgaagaaacgagacattacagaggcgtgagaaggaggccatgggggaaatttgcagcagagattcgagatccggcaaagaaaggatccaggatttggttaggcacttttgagagtgatattgatgctgcaagggcttacgactatgcagcttttaagctcaggggaagaaaagctgttctcaactttcctttggatgccggaaagtatgatgctccggtcaattcatgccgaaaaaggaggagaaccgatgtaccacagcctcaaggaacaacaacaagtacttcatcatcgtcatcaaactaatgggggaatagtgatgtttaattagtatatataggttaatatcttaagtatgtgaagcatcatgtatagagccaagaacctgttagactagtgtactgaaaagaactcttgcaaaatatgtactaaagagttcctgtaacaatggaacttctgcgttttctcttgtcttaaagagcttaaggttctagaaacaaagttcttgtcctttcggtttaaaaaaaaaaaaaaaaaaaaaaaaaaaaaaaaaaaaaaaaaaaaaaaaaaaa

SEQ ID NO: 2230 - protein, 201 aa, Arabidopsis thaliana
  G43
METFEESSDLDVIQKHLFEDLMIPDGFIEDFVFDDTAFVSGLWSLEPFNPVPKLEPSSPVLDPDSYVQEILQMEAESSSSSSTTTSPEVETVSNRKKTKRFEETRHYRGVRRRPWGKFAAEIRDPAKKGSRIWLGTFESDIDAARAYDYAAFKLRGRKAVLNFPLDAGKYDAPVNSCRKRRRTDVPQPQGTTTSTSSSSSN

SEQ ID NO: 2231 - DNA, 914 bp, Arabidopsis thaliana
  G147
aaatcatcagatagaaggaaatattctgattgagagatggctcgtggaaagattcagcttaagaggattgagaacccggttcacagacaagtgactttttgcaagaggagaactggtcttctcaagaaggctaaggagctctctgtgctctgtgatgccgagatcggtgttgtgatcttctctcctcagggcaagctctttgagctcgctactaaaggaacaatggagggaatgattgataagtacatgaagtgtactggtggtggtcgtggttcttcttctgctacttttactgctcaagaacaacttcaaccaccaaatcttgatccgaaagatgagatcaacgtgcttaagcaagagattgagatgcttcagaaagggataagctatatgtttggaggaggagatggggctatgaatcttgaagaacttcttttgcttgagaagcatcttgagtattggatttctcagattcgctctgctaagatggatgttatgcttcaagaaattcagtcattgaggaacaaggaaggagtcctcaaaaacaccaacaagtatctcctcgacaagatagaggaaaacaacaatagcatattagatgctaacttcgcagtcatggagacaaactattcctatccgctaacaatgccaagtgaaatatttcagttctagaccatagggtatttgaagactatgtctcacgaatttaaataaccttggtaagtataatatagtgttgttaaatcacacataattaaaataaagcctgtggaacttcgctaggcagttgaaaatctatccgtatgttttatcctcttgttttacatttgttggtgtgaagatgaaatgactgcaagtgtggtgtgtacttataactctttctactttctatctatgttttgaatttatggatt

SEQ ID NO: 2232 - protein, 211 aa, Arabidopsis thaliana
  G147
MARGKIQLKRIENPVHRQVTFCKRRTGLLKKAKELSVLCDAEIGVVIFSPQGKLFELATKGTMEGMIDKYMKCTGGGRGSSSATFTAQEQLQPPNLDPKDEINVLKQEIEMLQKGISYMFGGGDGAMNLEELLLLEKHLEYWISQIRSAKMDVMLQEIQSLRNKEGVLKNTNKYLLDKIEENNNSILDANFAVMETNYSYPLTMPSEIFQF

SEQ ID NO: 2233 - DNA, 1414 bp, Arabidopsis thaliana
  G158
gatctgggtattatagattgcagattctggaaacgtattatgttaatgattcatttcaagttttgattttttgtgttggattgaagagaagaatagtttattgatgttttgtgaagaagaagaagaagagattttgattttggtttaatatatagttggggattaacaggatgggaagggtaaaattgaagataaagaagttagagaacacaaatggacgccaatctacatttgctaaaaggaaaaatgggatcttgaaaaaggctaatgagctatctattctttgtgacattgatattgttcttcttatgttctctcctactggcaaggctgcaatatgttgcggtacacgaagatgtttctctttcgaaagctcagaacttgaagaaaactttccaaaagttggatcacgatgtaaatatacgcgaatttatagcctcaaggacttgagtactcaagcaaggattctgcaggctcggatttctgagatacatggaagattaagttattggacggaaccagataagattaacaatgttgaacacttgggacagctcgaaatttcgattaggcaatcccttgatcaattgcgtgcacacaagatgcaagatgggattcagattcctttagaacaacagcttcaatctatgtcatggattcttaatagcaacaccaccaacattgtcaccgaggaacacaattcaatcccgcagagggaagtcgagtgctcagcgagttcttcattcgggagctatccaggctactttggaacagggaaatctcctgaaatgacaattccgggtcaagaaacaagctttcttgatgaactaaacaccggacagctgaaacaggacacaagctcgcagcagcagttcactaataataataatatcacagcatacaatcccaatcttcacaatgatatgaatcatcaccaaacgttgcctcctcctcctcttcctcttactcttccgcatgctcaggtgtatattccaatgaatcagagagagtatcatatgaatggattctttgaagcaccaccacctgattcttctgcttacaacgacaacaccaaccaaaccaggtttggttctagcagcagctccttgccttgctcaatctcaatgttcgacgaatacttgttttcccagatgcagcagccgaactgagagagatttgatgaatgatgataaaacatctcactgaagaaactcaaaccaatattttttttcagaaacagcaagaaagctaaaactctgccgatttctgaattggttccaagaagaaaaaaaccagtggtaatccctggtagattgtgcaaccaaaccacacacaatacgtgttcatttattttttctatatcttcaatagatgtcacttaattcttttctatacataatttctcagtcagaat

SEQ ID NO: 2234 - protein, 332 aa, Arabidopsis thaliana
  G158
MGRVKLKIKKLENTNGRQSTFAKRKNGILKKANELSILCDIDIVLLMFSPTGKAAICCGTRRCFSFESSELEENFPKVGSRCKYTRIYSLKDLSTQARILQARISEIHGRLSYWTEPDKINNVEHLGQLEISIRQSLDQLRAHKMQDGIQIPLEQQLQSMSWILNSNTTNIVTEEHNSIPQREVECSASSSFGSYPGYFGTGKSPEMTIPGQETSFLDELNTGQLKQDTSSQQQFTNNNNITAYNPNLHNDMNHHQTLPPPPLPLTLPHAQVYIPMNQREYHMNGFFEAPPPDSSAYNDNTNQTRFGSSSSSLPCSISMFDEYLFSQMQQPN

SEQ ID NO: 2235 - DNA, 991 bp, Arabidopsis thaliana
  G160
tcaaatttgtcatttgtttattcaaatttttgagaaaatggtgagaagtaccaaaggtcgtcagaaaatagagatgaaaaaaatggaaaacgaaagcaaccttcaggttactttctcaaaaagaagattcggtcttttcaaaaaagctagtgaactttgcacattaagtggtgcagagattctgttgattgtgttctctcctggtgggaaagtgttttcttttggccatccaagtgttcaagaactcattcatcgcttttcgaatcctaaccataattctgccattgtccatcatcagaacaacaatctccaacttgttgaaacccgtccggatagaaatatccaatatctcaacaatatactcactgaggtgctggcaaaccaggaaaaggagaaacagaagagaatggttttggacctattgaaagaatccagagaacaagtaggaaactggtatgaaaaagatgtgaaagatctcgacatgaatgaaaccaaccagctgatatctgctcttcaagatgtgaaaaagaaactggtaagagaaatgtctcaatattctcaagtaaatgtttcgcagaattactttggtcaaagttctggcgtgattggtggtggtaatgttggcattgatctttttgatcaaagaagaaatgcattcaactataatccaaacatggtgtttcccaatcatacaccaccaatgtttggatacaacaatgatggagttctcgttccgatatccaacatgaactacatgtcaagttacaacttcaaccagagctagagtctgaagctagaagaacatcctaatcaatatttgcgttattttggctatggttactgttaggattgttcttgtattgtgagacttaagtttgttttttcttttaatttgtttcagttggttggtttttcattttattcgtcgtttgttttcctttgtttttggatatttttgtatcccagaataaatttatttatcctttaaaaa

SEQ ID NO: 2236 - protein, 248 aa, Arabidopsis thaliana
  G160
MVRSTKGRQKIEMKKMENESNLQVTFSKRRFGLFKKASELCTLSGAEILLIVFSPGGKVFSFGHPSVQELIHRFSNPNHNSAIVHHQNNNLQLVETRPDRNIQYLNNILTEVLANQEKEKQKRMVLDLLKESREQVGNWYEKDVKDLDMNETNQLISALQDVKKKLVREMSQYSQVNVSQNYFGQSSGVIGGGNVGIDLFDQRRNAFNYNPNMVFPNHTPPMFGYNNDGVLVPISNMNYMSSYNFNQS

SEQ ID NO: 2237 - DNA, 784 bp, Arabidopsis thaliana
  G165
cttcaaaacatctaaaaaatggtgaaaaaaactcttggtcgtagaaaggtagagatagtgaaaatgactaaggaatcaaaccttcaagtcacattttccaagagaaaagctggtctttttaagaaggctagtgaattttgcacattatgtgatgcaaaaattgcgatgatcgtgttttcaccagctggaaaagtattttcttttggtcatccaaatgttgatgttctgcttgaccactttcgagggtgtgttgtaggacacaacaacacaaaccttgatgaaagctacacaaagcttcatgttcaaatgctcaacaaatcctacactgaggtgaaggcggaagtagaaaaagaacaaaagaataagcagtcgcgggctcaaaatgaaagagaaaacgaaaacgctgaggagtggtggagtaagtctccattagaactcaacttaagtcaatcaacctgtatgatacgtgttcttaaagatttgaagaagatagttgatgaaaaagcaattcaattaatccatcaaacaaacccaaacttctatgttggaagttctagcaatgctgctgctccagcaactgttagtggtggtaatatctccacaaaccaggggttctttgatcaaaacggaatgacgactaatcctactcaaacacttctgtttggatttgatattatgaatcgcacaccaggagtttaaataagtctatcctcattatgggtcttggtactataagttcatctctctcgttgttgactttttaagtctccaatagtttgttgtg

SEQ ID NO: 2238 - protein, 226 aa, Arabidopsis thaliana
  G165
MVKKTLGRRKVEIVKMTKESNLQVTFSKRKAGLFKKASEFCTLCDAKIAMIVFSPAGKVFSFGHPNVDVLLDHFRGCVVGHNNTNLDESYTKLHVQMLNKSYTEVKAEVEKEQKNKQSRAQNERENENAEEWWSKSPLELNLSQSTCMIRVLKDLKKIVDEKAIQLIHQTNPNFYVGSSSNAAAPATVSGGNISTNQGFFDQNGMTTNPTQTLLFGFDIMNRTPGV

SEQ ID NO: 2239 - DNA, 1107 bp, Arabidopsis thaliana
  G170
atggggatgaagaaggtgaagctatctttgatagctaatgaaagatcaaggaaaacatccttcataaagaggaaagacgggatttttaagaaactccacgagttgtcaactctgtgtggtgtccaagcttgtgctctcatctacagtccattcataccggttccagagtcatggccgtcaagggaaggtgctaaaaaggtggcttcaaggtttctggagatgccgccgacagcccgaaccaagaagatgatggatcaagagacttaccttatggagaggattaccaaagcaaaagagcaactaaagaacctggctgctgagaaccgagagttacaggttagacgatttatgtttgattgtgttgaaggcaaaatgtcccagtatcattatgatgcaaaagaccttcaagatttgcaatcttgtataaatctatatctcgatcagcttaacggaaggatcgagtccattaaagaaaatggtgagtcgttgttgtcttccgtctctccttttcctactagaattggtgttgacgaaattggtgatgagtcattttccgactctcctattcatgctacaactggggttgtagatactcttaatgctaccaatcctcatgttcttacgggcgatatgactccttttcttgatgcggacgcaactgcggtaactgcttccagtagattttttgatcatattccatatgaaaatatgaatatgagtcaaaatctgcatgaaccgtttcaacaccttgttcctactaacgtttgtgatttttttcaaaatcagaatatgaatcaggttcaataccaggctcctaataatctgtttaatcagattcaacgagaattctacaacataaatttgaatctgaatttgaatctgaattcgaatcagtatctgaatcaacaacaatcattcatgaatccgatggtggaacaacatatgaatcatgttggagggcgtgaaagcattcctttcgtggacggaaactgctacaactaccatcaactaccatccaatcaactaccagccgttgatcatgcttccaccagttacatgccttccaccaccggtgtctatgatccttacatcaacaataatctctaa

SEQ ID NO: 2240 - protein, 368 aa, Arabidopsis thaliana
  G170
MGMKKVKLSLIANERSRKTSFIKRKDGIFKKLHELSTLCGVQACALIYSPFIPVPESWPSREGAKKVASRFLEMPPTARTKKMMDQETYLMERITKAKEQLKNLAAENRELQVRRFMFDCVEGKMSQYHYDAKDLQDLQSCINLYLDQLNGRIESIKENGESLLSSVSPFPTRIGVDEIGDESFSDSPIHATTGVVDTLNATNPHVLTGDMTPFLDADATAVTASSRFFDHIPYENMNMSQNLHEPFQHLVPTNVCDFFQNQNMNQVQYQAPNNLFNQIQREFYNINLNLNLNLNSNQYLNQQQSFMNPMVEQHMNHVGGRESIPFVDGNCYNYHQLPSNQLPAVDHASTSYMPSTTGVYDPYINNNL

SEQ ID NO: 2241 - DNA, 1888 bp, Arabidopsis thaliana
  G174
cccaatttgagattgttcgatttcgatctacgagattcttacaagaacataagcagcttcggttttttgggattatcttatttggtcggatgatgatcttctcgatgtctgtgctaggctttgggaattagatatatttggggttaagctcgagtctctccggttttgagtttacttgagtttgttagtatttatggctgaggtgggaaaagttctggctagtgatatggagttagaccattcaaatgagactaaagcagtggatgatgttgttgccactactgataaagcggaggtcataccagtggctgtaactagaactgaaaccgttgttgaaagtttggaatctactgactgtaaggagcttgaaaaacttgttccacatacggtagcttcgcagtcggaagtagatgttgcttccccggtatccgagaaagcaccgaaggtttctgaaagtagcggtgcattatctttgcagtctggttcggaagggaatagtccttttattcgtgagaaggttatggaagacggatacaactggcggaaatatggacagaaacttgtgaaaggaaatgagtttgtaaggagctattacaggtgcactcaccctaactgcaaagcgaaaaaacagttggaacggtctgcgggtggacaagtcgtggataccgtttactttggggaacatgatcacccaaagcctcttgctggtgctgttcctatcaatcaggataagcgaagtgatgtcttcacagctgttagtaaagagaaaacatctggatccagtgttcagacacttcgtcaaaccgaaccaccaaagatccatggaggattacatgtttcagttattccaccagctgatgatgtgaaaactgatatttcacaatcaagtaggataacgggggacaacactcacaaggattataatagtcctaccgcaaagcgaaggaagaaaggagggaacattgagctgagtccagtggagaggtcaaccaatgattcacgcattgtggttcacactcagactctgtttgatattgtgaatgatgggtaccgatggcgtaaatatggtcagaaatcagtaaaaggcagcccatatccaaggagctactatagatgttcaagccctggatgccccgtcaagaaacacgtagagaggtcatctcatgacacaaagttgcttataacaacttacgagggaaaacacgaccacgatatgcctccaggaagagttgttactcataataacatgctggactcggaagttgatgataaagaaggagatgccaacaagactccacagagctcaactcttcaatccattacaaaagaccagcatgtcgaagatcacttaagaaagaaaacgaagactaatggctttgagaaaagtcttgatcaaggtccagttttggatgagaagctgaaggaggaaataaaagagagatcagatgcaaacaaagatcacgcagccaatcacgccaagccggaagcaaagtcagatgataaaaccactgtttgtcaagagaaggcagtaggaaccctggagagcgaggaacaaaaacccaagacagagcctgcccaaagctaagcattcagtgttgtaccgagtggtaatttatatggctgttttaacatagattagtacaggcgatatggttatagactgtacagttgttgttcaggcgggaccagatttagattagtgtttaatggaatagtatgctttaatacctttatgtaaccacttccatttggttcaaataagagttacaggaagagaaggtaacacaacaagagcccttctttgttgatggagcctgtgtaatagttgtagcatggggatgtatatgatttgattcaaccttattaatggttatgagacaaaactatc

SEQ ID NO: 2242 - protein, 463 aa, Arabidopsis thaliana
  G174
MAEVGKVLASDMELDHSNETKAVDDVVATTDKAEVIPVAVTRTETVVESLESTDCKELEKLVPHTVASQSEVDVASPVSEKAPKVSESSGALSLQSGSEGNSPFIREKVMEDGYNWRKYGQKLVKGNEFVRSYYRCTHPNCKAKKQLERSAGGQVVDTVYFGEHDHPKPLAGAVPINQDKRSDVFTAVSKEKTSGSSVQTLRQTEPPKIHGGLHVSVIPPADDVKTDISQSSRITGDNTHKDYNSPTAKRRKKGGNIELSPVERSTNDSRIVVHTQTLFDIVNDGYRWRKYGQKSVKGSPYPRSYYRCSSPGCPVKKHVERSSHDTKLLITTYEGKHDHDMPPGRVVTHNNMLDSEVDDKEGDANKTPQSSTLQSITKDQHVEDHLRKKTKTNGFEKSLDQGPVLDEKLKEEIKERSDANKDHAANHAKPEAKSDDKTTVCQEKAVGTLESEEQKPKTEPAQS

SEQ ID NO: 2243 - DNA, 1674 bp, Arabidopsis thaliana
  G176
agaagaagaagaagaagagtacctcatacgtaaaccattgatgggctcttttgatcgccaaagagctgttccgaaattcaaaacagcaacaccgtcaccgctccctctttctccttcgccttacttcactatgcctcctggccttactcccgccgactttctcgactctcctcttctcttcacttcctccaacattttgccgtctcctacgacaggcacatttccagcgcaatctctgaactataacaataacggtttgctcattgacaaaaatgaaatcaaatatgaagacacaactcctcccttgttcctaccatctatggtaactcagcctttacctcaactggatttattcaaatccgaaatcatgtcgagtaacaaaacctctgatgacggctacaattggcgcaaatacgggcagaagcaagtcaaaggaagcgaaaacccgaggagttacttcaaatgcacgtatccaaattgtctcacaaagaagaaagtagagacgtctcttgtgaagggtcagatgattgagattgtctataaaggaagccacaatcatcccaagccccaatccacgaagcgatcatcttccaccgctatagcagcacatcagaacagcagtaatggagacggtaaagacattggtgaagatgaaacagaggccaagagatggaaaagagaagagaatgtgaaggagccaagagtggtggttcagacaacaagtgatatagacattcttgacgatggctacagatggagaaagtatggtcagaaagtcgtcaagggtaatccaaatccaaggagctattacaagtgcacatttacaggatgttttgtaaggaaacacgttgaaagagcatttcaagatcccaagtcagtgatcacaacttacgaaggaaaacacaaacaccaaatcccgaccccaagaagaggtccagttttaagatctgctgcaatggcttctcctcttctcccaacttcgactactcctgatcaacttcccggcggcgatccacagttgctgagctctctacgcgtcctcttgtcccgcgttctagccaccgtccgtcacgcttctgcagatgccagaccctgggcagagctcgttgaccggtcagcgttttcccggccaccatcgctctcggaggcaacgtcacgagtaaggaagaacttttcctatttccgagccaattacataaccttagtggcaatcttactcgccgcgtctctgctcacgcaccctttcgctctcttcctcctcgcatcgctggccgcttcttggcttttcctctactttttccgtccggcggatcagccgttggtcattggaggacgcacgttctccgatcttgagacgctagggatactctgcctgtccactgtggtggtgatgttcatgaccagcgttggatcgctcttgatgtccactctagcagttgggatcatgggcgtggccatccacggagcgtttcgtgctcccgaagacctgtttcttgaagaacaagaagccattggatctggacttttcgcattcttcaacaacaatgcctctaatgcagctgccgctgccatagccacctcagcaatgtcacgcgttcgagtctgagattgttgaagagactacattcctacaccgcatttccaaagtgtgatatttattcatattgaattgtt

SEQ ID NO: 2244 - protein, 521 aa, Arabidopsis thaliana
  G176
MGSFDRQRAVPKFKTATPSPLPLSPSPYFTMPPGLTPADFLDSPLLFTSSNILPSPTTGTFPAQSLNYNNNGLLIDKNEIKYEDTTPPLFLPSMVTQPLPQLDLFKSEIMSSNKTSDDGYNWRKYGQKQVKGSENPRSYFKCTYPNCLTKKKVETSLVKGQMIEIVYKGSHNHPKPQSTKRSSSTAIAAHQNSSNGDGKDIGEDETEAKRWKREENVKEPRVVVQTTSDIDILDDGYRWRKYGQKVVKGNPNPRSYYKCTFTGCFVRKHVERAFQDPKSVITTYEGKHKHQIPTPRRGPVLRSAAMASPLLPTSTTPDQLPGGDPQLLSSLRVLLSRVLATVRHASADARPWAELVDRSAFSRPPSLSEATSRVRKNFSYFRANYITLVAILLAASLLTHPFALFLLASLAASWLFLYFFRPADQPLVIGGRTFSDLETLGILCLSTVVVMFMTSVGSLLMSTLAVGIMGVAIHGAFRAPEDLFLEEQEAIGSGLFAFFNNNASNAAAAAIATSAMSRVRV

SEQ ID NO: 2245 - DNA, 1974 bp, Arabidopsis thaliana
  G184
tgaattctagcctttttgtaggcgaatcatctggaccggtaagagactctctcatcgataataaccacataatttaatcaaactctttctctctctttctaagatcttttgctttgctcttttcctttttgatcttcctatatatggagaagcaccaaaacggtacttactatacgatactgtacggatccatcaaactggattaattatcaaaacgtacatttttatcttacctggcaagttacattcctagggttttggagaatccaatcaacaacaaagaaaataatcatcgttacaataatcagtatcacgcacagacttagatgttccggtttccagtgagtctaggcggttcacgtgacgaagaccgtcacgatcagatcacaccgttggatgaccatcgtgtggtggttgatgaggttgacttcttctcagagaagagagatagggtttcacgtgagaacatcaacgacgacgacgacgaaggcaataaggttctcatcaaaatggagggttcacgagttgaagaaaacgatcgttccagagatgtcaatatcggtctgaatcttctgaccgcgaatacgggaagcgatgagtcaacggtggatgatggactatcaatggatatggaagataaacgtgcaaagattgagaacgcacaactacaagaagagctcaagaagatgaaaatagagaatcaaaggctaagagatatgttgagccaagcgacgaccaacttcaatgccttacaaatgcaacttgttgccgtcatgaggcaacaagaacaacgtaactcttcacaagatcatctcctggagagcaaagcagaaggaaggaaacggcaggaactgcaaatcatggtgccaaggcagttcatggaccttgggccgtcgtctggagcagcagagcatggagccgaagtgtcatctgaagagaggacaacggttcgttcaggttctcctccttcgcttctagaaagttccaatccccgagagaacggaaagaggttgcttggaagagaagaaagctcagaggaatcagagtctaacgcctggggaaaccctaacaaagtccccaaacataatccatcctctagcaatagcaatggaaacagaaacggaaatgttattgatcagtcggccgcagaagccaccatgcggaaagcccgtgtctcagttcgtgcccgatctgaagctgccatgataagcgatggatgtcaatggagaaagtacggacaaaaaatggctaaaggaaacccgtgtccgcgggcttattatcgttgcacaatggccggtggatgtccagttcgcaagcaagtgcagcgttgcgcagaagacagatctattctcataaccacctacgaaggaaaccacaaccatccactcccaccagccgctacggccatggcctcaacaaccaccgcagctgcaagcatgctcctctcgggctcaatgtcgagtcaagacggtttaatgaacccaacaaacctcctagctcgagctatcttgccttgctcctcaagcatggctacaatctcagcctccgcaccattcccaaccatcacattggacctcaccaattcacccaacggtaacaaccctaatatgaccactaataacccgttgatgcagttcgctcaacggcccggtttcaacccggcagttttgcctcaagtggttggtcaagctatgtacaataaccaacaacagtccaagttttctggtttacagttaccggctcagccactgcagatcgcggccacttcctcggtggccgagagcgttagtgctgccagtgcagcaattgcgtccgatccaaactttgcggcggctctagcggcagcgatcacgtccattatgaacggttccagtcatcaaaataataacaccaataataataatgtggctacgagcaacaatgacagtaggcaataagagttttcattttgatggtcgatttttttttttgggg

SEQ ID NO: 2246 - protein, 536 aa, Arabidopsis thaliana
  G184
MFRFPVSLGGSRDEDRHDQITPLDDHRVVVDEVDFFSEKRDRVSRENINDDDDEGNKVLIKMEGSRVEENDRSRDVNIGLNLLTANTGSDESTVDDGLSMDMEDKRAKIENAQLQEELKKMKIENQRLRDMLSQATTNFNALQMQLVAVMRQQEQRNSSQDHLLESKAEGRKRQELQIMVPRQFMDLGPSSGAAEHGAEVSSEERTTVRSGSPPSLLESSNPRENGKRLLGREESSEESESNAWGNPNKVPKHNPSSSNSNGNRNGNVIDQSAAEATMRKARVSVRARSEAAMISDGCQWRKYGQKMAKGNPCPRAYYRCTMAGGCPVRKQVQRCAEDRSILITTYEGNHNHPLPPAATAMASTTTAAASMLLSGSMSSQDGLMNPTNLLARAILPCSSSMATISASAPFPTITLDLTNSPNGNNPNMTTNNPLMQFAQRPGFNPAVLPQVVGQAMYNNQQQSKFSGLQLPAQPLQIAATSSVAESVSAASAAIASDPNFAAALAAAITSIMNGSSHQNNNTNNNNVATSNNDSRQ

SEQ ID NO: 2247 - DNA, 1205 bp, Arabidopsis thaliana
  G185
atgcaaaaataaacatagtaacaatactttaaactatttacaccactttaatcttattctccactctttgaacgtaatggagaagaaccatagtagtggagagtgggagaagatgaagaacgagatcaacgagctaatgatagaaggaagagactatgcacaccagtttggatcagcttcatctcaagaaacacgtgaacatttagccaaaaagattcttcaatcttaccacaagtctctcaccatcatgaactactccggcgaacttgaccaagtttctcagggtggaggaagccccaagagcgatgattccgatcaagaaccacttgtcatcaagagttcgaagaagtcaatgccaaggtggagttcaaaagtcagaattgcccctggagctggtgttgatagaacgctggacgatggattcagttggagaaagtacggccagaaggatattctcggagccaaatttccaagaggatactatagatgcacgtatagaaagtctcaaggatgtgaagccactaaacaagtccaaagatctgatgaaaatcagatgctccttgagatcagttaccgaggaatacattcttgctctcaagctgcaaatgtcggtacaacaatgccgatacaaaacctcgaaccgaaccagacccaagaacacggaaatcttgacatggtaaaggaaagtgtagacaactacaatcaccaagcacatttgcatcacaaccttcactatccattgtcatctaccccaaatctagagaataacaatgcctatatgcttcaaatgcgagatcaaaacatcgaatattttggatctacgagcttctctagtgatctaggaactagtatcaactacaattttccagcatctggctcggcttctcactcagcatcaaactctccgtccaccgtccctttggaatccccgtttgaaagctatgatccaaatcatccatatggaggatttggtgggttctattcttagttatctacttaagggagggacggaactttttacatgacctcttgattaaagagagagttttcataatagctaatcaatttcctattcaaatatccgagttttttttctaatcatgtttatcaattgtcttattacagaaggcttattttcaggtctatgttgaaataaatggatttgtactcgtaggtatgatccttgttatctaaaaaaaaaaaaa

SEQ ID NO: 2248 - protein, 303 aa, Arabidopsis thaliana
  G185
MEKNHSSGEWEKMKNEINELMIEGRDYAHQFGSASSQETREHLAKKILQSYHKSLTIMNYSGELDQVSQGGGSPKSDDSDQEPLVIKSSKKSMPRWSSKVRIAPGAGVDRTLDDGFSWRKYGQKDILGAKFPRGYYRCTYRKSQGCEATKQVQRSDENQMLLEISYRGIHSCSQAANVGTTMPIQNLEPNQTQEHGNLDMVKESVDNYNHQAHLHHNLHYPLSSTPNLENNNAYMLQMRDQNIEYFGSTSFSSDLGTSINYNFPASGSASHSASNSPSTVPLESPFESYDPNHPYGGFGGFYS

SEQ ID NO: 2249 - DNA, 1136 bp, Arabidopsis thaliana
  G187
tagacctcttaggaaaaaaacctaaaaacctaatccccaaacctaaaaggcttatctcatctcttcttctttgtcttctttactctttttttacctctctcttcattgttcttcaccatgtctaatgaaaccagagatctctacaactaccaatacccttcatcgttttcgttgcacgaaatgatgaatctgcctacttcaaatccatcttcttatggaaacctcccatcacaaaacggttttaatccatctacttattccttcaccgattgtctccaaagttctccagcagcgtatgaatctctacttcagaaaacttttggtctttctccctcttcctcagaggttttcaattcttcgatcgatcaagaaccgaaccgtgatgttactaatgacgtaatcaatggtggtgcatgcaacgagactgaaactagggtttctccttctaattcttcctctagtgaggctgatcaccccggtgaagattccggtaagagccggaggaaacgagagttagtcggtgaagaagatcaaatttccaaaaaagttgggaaaacgaaaaagactgaggtgaagaaacaaagagagccacgagtctcgtttatgactaaaagtgaagttgatcatcttgaagatggttatagatggagaaaatacggccaaaaggctgtaaaaaatagcccttatccaaggagttactatagatgtacaacacaaaagtgcaacgtgaagaaacgagtggagagatcgttccaagatccaacggttgtgattacaacttacgagggtcaacacaaccacccgattccgactaatcttcgaggaagttctgccgcggctgctatgttctccgcagacctcatgactccaagaagctttgcacatgatatgtttaggacggcagcttatactaacggcggttctgtggcggcggctttggattatggatatggacaaagtggttatggtagtgtgaattcaaaccctagttctcaccaagtgtatcatcaagggggtgagtatgagctcttgagggagatttttccttcaattttctttaagcaagagccttgatcgatcattgttataactacatatattatatatattgagagagagaggtagagaaaaaaaaa

SEQ ID NO: 2250 - protein, 318 aa, Arabidopsis thaliana
  G187
MSNETRDLYNYQYPSSFSLHEMMNLPTSNPSSYGNLPSQNGFNPSTYSFTDCLQSSPAAYESLLQKTFGLSPSSSEVFNSSIDQEPNRDVTNDVINGGACNETETRVSPSNSSSSEADHPGEDSGKSRRKRELVGEEDQISKKVGKTKKTEVKKQREPRVSFMTKSEVDHLEDGYRWRKYGQKAVKNSPYPRSYYRCTTQKCNVKKRVERSFQDPTVVITTYEGQHNHPIPTNLRGSSAAAAMFSADLMTPRSFAHDMFRTAAYTNGGSVAAALDYGYGQSGYGSVNSNPSSHQVYHQGGEYELLREIFPSIFFKQEP

SEQ ID NO: 2251 - DNA, 1418 bp, Arabidopsis thaliana
  G194
tctttcttctctctctatctctcctctttgaaccctaaaaactctttctttacaaggattgatctttttgtatttttgattttgacatttgctttgtgttcgatctctgttttgatgcgatttctctgtttttaaagccatttgatagattgtttccggtaaagctcagcgagagaagaagaagaacaacaatggagtttacagatttctcaaagacgagtttttactacccgtcgtcacaaagcgtttgggatttcggagatttagcggcggcggagaggcattctttagggttcatggagttattaagttctcagcagcatcaagactttgctactgtttctcctcattccttccttctccaaacgtctcaaccgcaaacgcaaacgcaaccatcggcgaagctgtcttcaagtatcattcaagctccaccgtcagagcaattagtgacgtcaaaggtggagtctttgtgttcggatcatttgttgataaacccaccggcgactcctaactcgtcatcgatttcgtctgcttcaagcgaggctctaaatgaagagaaaccgaaaacagaagacaatgaagaagaaggaggtgaagatcaacaagagaagagtcatactaagaaacagttgaaagcaaagaagaataatcagaagagacagagagaggcaagagtcgcattcatgacaaagagtgaagttgatcatctcgaagatggttatcgctggcgaaaatatggtcaaaaagctgtcaaaaacagtccttttcccaggagttactaccgttgcacaacggcttcatgtaacgtgaagaagagagtggagagatcattcagagatccaagcactgtggttacaacctacgaaggtcaacacactcacattagtccactcacgtctcgtcctatttccactggaggtttcttcggatcgtcaggagctgcttcgagtctcggtaatggttgctttgggtttcctattgatggctccacgttaatctctcctcagttccaacagcttgtccaataccatcaccaacagcagcaacaagaactcatgtcttgttttggaggagtcaacgagtaccttaatagccacgctaatgagtatggtgatgataatcgtgtgaagaagagtcgagttttggttaaagataatggacttctgcaagatgttgttccgtctcatatgttgaaggaagagtagtagtatatatatagtcttatagttttaatctagtttttttttgtataattgtctaaaagaaacggatcttttgttctgatgaagaagatgttttcttatggttctgaaatcgtaaggtaatgatgattgtaccaagccgagaaagtacttgtgattttcaccattgaatcactataaatgtaatttttatttactgtgaaaaaaaaaaaaaaa

SEQ ID NO: 2252 - protein, 337 aa, Arabidopsis thaliana
  G194
MEFTDFSKTSFYYPSSQSVWDFGDLAAAERHSLGFMELLSSQQHQDFATVSPHSFLLQTSQPQTQTQPSAKLSSSIIQAPPSEQLVTSKVESLCSDHLLINPPATPNSSSISSASSEALNEEKPKTEDNEEEGGEDQQEKSHTKKQLKAKKNNQKRQREARVAFMTKSEVDHLEDGYRWRKYGQKAVKNSPFPRSYYRCTTASCNVKKRVERSFRDPSTVVTTYEGQHTHISPLTSRPISTGGFFGSSGAASSLGNGCFGFPIDGSTLISPQFQQLVQYHHQQQQQELMSCFGGVNEYLNSHANEYGDDNRVKKSRVLVKDNGLLQDVVPSHMLKEE

SEQ ID NO: 2253 - DNA, 1269 bp, Arabidopsis thaliana
  G195
  misc_feature (1239)..(1239): n is a, c, g, or t
  misc_feature (1242)..(1242): n is a, c, g, or t
  misc_feature (1244)..(1244): n is a, c, g, or t
  misc_feature (1261)..(1263): n is a, c, g, or t
  misc_feature (1266)..(1267): n is a, c, g, or t
ttttctttttctttctttttggtttaagttttttctctttgttcttcgtcatgtctcatgaaatcaaagatcttaacaactatcactacacttcatcgtataatcattacaatatcaacaaccaaaatatgattaatctcccttacgtttctggtccatctgcttataatgcaaacatgatctcatcatcacaagtaggttttgatctaccctcgaagaacttgagtcctcaaggagccttcgagttgggtttcgagctttctccatcttcttctgacttttttaatccttccctcgatcaagagaacggtttgtataatgcttataattataatagtagtcaaaagagtcatgaagttgtcggtgatggttgtgcaaccattaagagtgaagttagggtttcagcatctccttcttcaagtgaggccgatcatcatccaggagaagattccggcaagatccggaagaaaagagaagttcgcgatggaggagaagatgatcaacgctctcagaaagtagttaaaacaaagaagaaagaggagaagaaaaaagagccacgagtctcgttcatgactaagaccgaagttgatcatctcgaagacggctatcgttggagaaagtatggccaaaaagcagtcaaaaacagtccttatccgaggagttactatagatgcacgactcagaagtgcaacgtgaagaagagagtggagagatcttaccaagacccaacggtcgtcatcacaacctacgagagtcaacacaaccatccgatcccgaccaatcgtcggacagcaatgttctctggaaccaccgcatctgattataacccatcatcgtctccaatattctccgatctcatcatcaatactccaagaagcttctcaaatgatgatctcttccgtgtgccatacgctagtgtgaacgtgaaccctagttatcatcaacagcaacatggatttcatcaacaggagagtgagttcgagctcttgaaggagatgtttccttcggttttcttcaaacaagagccttgatgatataatataatatagaaacaattttttttctgctaagaaatatagaacaaaacttggatgcataataagtgatgatagtgttatttattttttgcatgtatatattatacatgttttgttaactagctataggatatactggtagtaattaagcataaatatggagcccttcgacttattacaataatttttggtatggaaaaanttngntacatgcctgccttttnnnttnngg

SEQ ID NO: 2254 - protein, 326 aa, Arabidopsis thaliana
  G195
MSHEIKDLNNYHYTSSYNHYNINNQNMINLPYVSGPSAYNANMISSSQVGFDLPSKNLSPQGAFELGFELSPSSSDFFNPSLDQENGLYNAYNYNSSQKSHEVVGDGCATIKSEVRVSASPSSSEADHHPGEDSGKIRKKREVRDGGEDDQRSQKVVKTKKKEEKKKEPRVSFMTKTEVDHLEDGYRWRKYGQKAVKNSPYPRSYYRCTTQKCNVKKRVERSYQDPTVVITTYESQHNHPIPTNRRTAMFSGTTASDYNPSSSPIFSDLIINTPRSFSNDDLFRVPYASVNVNPSYHQQQHGFHQQESEFELLKEMFPSVFFKQEP

SEQ ID NO: 2255 - DNA, 1107 bp, Arabidopsis thaliana
  G207
aaaagatctgtttcaatggcggatcgtgttaaaggtccatggagtcaagaagaagatgagcagctacgaaggatggttgagaaatacggaccgaggaattggtctgcgattagcaaatcgattccaggtcgatctggtaaatcgtgtagattacgttggtgtaatcagttatctccggaggttgagcatcgtcctttctcgccggaggaagatgagactattgtaaccgcccgtgctcagtttggtaacaagtgggcgacgattgctcgtcttcttaacggtcgtacggataacgccgttaaaaatcactggaactctacgcttaagaggaaatgcagcggaggtgtggcggttacgacggtgacggagacggaggaagatcaggatcggccgaagaagaggagatctgttagctttgatcctgcttttgctccggtggatactggattgtacatgagtcctgagagtcctaacggaatcgatgttagtgattctagcacgattccgtcaccgtcgtctcctgttgctcagctgtttaaaccaatgccgatttccggcggttttacggtggttccgcagccgttaccggttgaaatgtcttcgtcttcggaggatccacctacttcgttgagtttgtcactacctggagctgagaacacgagttcgagccataacaataacaacaacgcgttgatgtttccgagatttgagagtcagatgaagattaatgtagaggagagaggaggaggaggagaaggacgtagaggtgagtttatgacggtggtgcaggagatgataaaagctgaagtgaggagttacatggcggaaatgcagaaaacaagtggtggattcgtcgtcggaggtttatacgaatccggcggcaatggtggttttagggattgtggagtaataacacctaaggttgagtagttttggtttagggttaaaacttgaatcgattggggattttcaagagcattcatttttggggtttatggtaaaattaaaaacaaaaacaaaatgtacagaggaattaaaatttctatggaataatcttaaatctcaaatatttgttacttgttttggtgattcataaccaaaatcaaa

SEQ ID NO: 2256 - protein, 304 aa, Arabidopsis thaliana
  G207
MADRVKGPWSQEEDEQLRRMVEKYGPRNWSAISKSIPGRSGKSCRLRWCNQLSPEVEHRPFSPEEDETIVTARAQFGNKWATIARLLNGRTDNAVKNHWNSTLKRKCSGGVAVTTVTETEEDQDRPKKRRSVSFDPAFAPVDTGLYMSPESPNGIDVSDSSTIPSPSSPVAQLFKPMPISGGFTVVPQPLPVEMSSSSEDPPTSLSLSLPGAENTSSSHNNNNNALMFPRFESQMKINVEERGGGGEGRRGEFMTVVQEMIKAEVRSYMAEMQKTSGGFVVGGLYESGGNGGFRDCGVITPKVE

SEQ ID NO: 2257 - DNA, 1110 bp, Arabidopsis thaliana
  G215
atgactcgtcggtgttcgcattgtagcaacaatgggcacaattcacgcacgtgtccaacgcgtgggtctggttcctcctccgccgtgaagttatttggtgtgaggttaacggatggctcgattattaaaaagagtgcgagtatgggtaatctctcggcattggctgttgcggcggcggcggcaacgcaccaccgtttatctccgtcgtctcctctggcgacgtcaaatcttaatgattcgccgttatcggatcatgcccgatactctaatttgcatcataatgaagggtatttatctgatgatcctgctcatggttctgggtctagtcaccgtcgtggtgagaggaagagaggtgttccttggactgaagaggaacatagactattcttagtcggtcttcagaaactcgggaaaggagattggcgcggtatttcgagaaactatgtaacgtcaagaactcctacacaagtggctagtcatgctcaaaagtattttattcgacatactagttcaagccgcaggaaaagacggtctagcctcttcgacatggttacagatgagatggtaaccgattcatcgccaacacaggaagagcagaccttaaacggttcctctccaagcaaggaacctgaaaagaaaagctaccttccttcacttgagctctcactcaataataccacagaagctgaagaggtcgtagccacggcgccacgacaggaaaaatctcaagaagctatagaaccatcaaatggtgtttcaccaatgctagtcccgggtggcttctttcctccttgttttccagtgacttacacgatttggctccctgcgtcacttcacggaacagaacatgccttaaacgctgagacttcttctcagcagcatcaggtcctaaaaccaaaacctggatttgctaaagaacgtgtgaacatggacgagttggtcggtatgtctcagcttagcataggaatggcgacaagacacgaaaccgaaacttccccttccccgctatctttgagactagagccctcaaggccatcagcgtttcactcgaatggctcggttaatggtgcagatttgagtaaaggcaacagcgcgattcaggctatctaa

SEQ ID NO: 2258 - protein, 369 aa, Arabidopsis thaliana
  G215
MTRRCSHCSNNGHNSRTCPTRGSGSSSAVKLFGVRLTDGSIIKKSASMGNLSALAVAAAAATHHRLSPSSPLATSNLNDSPLSDHARYSNLHHNEGYLSDDPAHGSGSSHRRGERKRGVPWTEEEHRLFLVGLQKLGKGDWRGISRNYVTSRTPTQVASHAQKYFIRHTSSSRRKRRSSLFDMVTDEMVTDSSPTQEEQTLNGSSPSKEPEKKSYLPSLELSLNNTTEAEEVVATAPRQEKSQEAIEPSNGVSPMLVPGGFFPPCFPVTYTIWLPASLHGTEHALNAETSSQQHQVLKPKPGFAKERVNMDELVGMSQLSIGMATRHETETSPSPLSLRLEPSRPSAFHSNGSVNGADLSKGNSAIQAI

SEQ ID NO: 2259 - DNA, 2807 bp, Arabidopsis thaliana
  G217
cttcgttcttaccgagttccacgagcattagcttcagagaccttgaattggagtgcggttggatcaaaaacagttgagcgaagatgaggattatgattaagggaggtgtttggaagaacaccgaagatgagattctcaaagccgccgtgatgaagtatggtaagaaccaatgggctcggatctcgtctcttctcgttcgtaagtctgctaaacagtgtaaagctcgctggtacgagtggctcgatccatctatcaaaaagactgaatggaccagagaagaagatgagaagcttctacatcttgctaaacttctgcctactcaatggagaactattgctcctattgtgggtcgtacaccatctcaatgtcttgagaggtatgagaagctccttgatgcagcatgcactaaggatgaaaattatgatgcagcggatgatccacgaaaattacgtcctggtgagattgatccgaacccagaagcaaagcctgctcgtcctgatccggtagacatggacgaagatgagaaagaaatgctttctgaagcaagagctagattggctaacacgaggggaaagaaggctaaaagaaaagctagagaaaaacaacttgaggaagctagaaggcttgcttctctgcaaaaaagaagagaactaaaagcagctgggattgatggaaggcataggaaaagaaagagaaagggaatcgactataatgcagaaattccttttgaaaagagggcacctgcgggattttatgatactgcggatgaagatcgtcctgctgatcaagtaaaatttccaactaccattgaagaacttgaaggaaaaagaagagctgatgtagaagcacatttacgcaaacaagatgttgcaaggaataaaattgctcagagacaggatgctccagcagctatattgcaagcaaacaagctgaatgatccggaagttgttaggaagaggtcaaagctgatgttaccaccaccgcagatttcagaccacgagctagaagaaattgctaagatgggctatgccagtgaccttcttgccgagaatgaggagctaacagaaggcagtgctgctactcgtgcacttttggcaaattactcacaaacaccaaggcaaggaatgacacccatgaggacacctcaaagaactcctgctggtaaaggtgatgctattatgatggaagcagaaaacctggccagattaagagactctcagacacctttgctaggaggagaaaatcctgagttgcacccttctgacttcactggggtcactccgagaaagaaggagattcaaacgcctaatccaatgttgaccccttcaatgactcctggtggtgctggtcttactccaagaattggcttgacgccatcaagggatgggtcttctttttctatgacacccaaagggactcccttcagggatgaacttcacattaacgaagacatggacatgcagcaaagtgcaaaacttgagaggcagagacgagaggaagctagaaggagtttacgctctggtttgactgggcttcctcagccaaagaacgagtaccaaatagttgcacaacctcctcctgaggaaagtgaagagccagaagagaaaattgaggaagacatgtcagacaggatagcgagggaaaaggcggaggaagaagcaagacaacaggcattgcttaagaagagatccaaggtcttgcagagagatcttcctagacccccagctgcttcattggcagtaattaggaactcgttgctttcagctgatggagacaaaagttctgttgttcctcctactccgattgaggttgcagataaaatggtaagagaggagcttctacagttgctggagcatgataatgcaaagtatccgcttgatgacaaagctgagaagaagaaaggagccaagaaccgtaccaaccgttctgcttctcaagttcttgcaattgacgattttgatgaaaatgagctccaagaggctgacaaaatgataaaggaggaggggaagtttctgtgtgtgtcaatgggacatgagaacaagacacttgatgattttgtagaagctcacaacacatgcgtgaatgatctcatgtatttccccactcgaagcgcttacgagctctcaagtgttgctgggaacgcggacaaagttgcagcttttcaggaggagatggagaatgtgagaaaaaagatggaggaggatgagaagaaggcagaacacatgaaggccaagtacaaaacttatacaaagggtcatgagaggagggcagagaccgtgtggacccaaatagaggcgacattgaagcaggctgagattggtggaacagaagtagagtgctttaaagcattgaagaggcaagaagagatggctgcatcttttaggaaaaagaatttgcaagaggaagtgataaagcaaaaggaaacagagagtaaactgcagactcgctatgggaatatgttggcaatggttgaaaaagcagaggagataatggtcggtttccgagcacaggcattgaagaaacaagaggatgttgaagattctcacaaactgaaagaagctaagctagccactggagaggaagaggacatagccatagccatggaagcttctgcataaaaacttgagttttgtattgcttacaagttttaaggagacgtagcttgactttgtattggtaagtttttttaatatgagtcatgactttgtaaaaaggttatgatatattctctgtttgtatgctttgcaagagtcaagaaatttgaatgcttcaggatcaaaaaaaaaaaaaaaaaaaaaaaaaaaaaa

SEQ ID NO: 2260 - protein, 844 aa, Arabidopsis thaliana
  G217
MRIMIKGGVWKNTEDEILKAAVMKYGKNQWARISSLLVRKSAKQCKARWYEWLDPSIKKTEWTREEDEKLLHLAKLLPTQWRTIAPIVGRTPSQCLERYEKLLDAACTKDENYDAADDPRKLRPGEIDPNPEAKPARPDPVDMDEDEKEMLSEARARLANTRGKKAKRKAREKQLEEARRLASLQKRRELKAAGIDGRHRKRKRKGIDYNAEIPFEKRAPAGFYDTADEDRPADQVKFPTTIEELEGKRRADVEAHLRKQDVARNKIAQRQDAPAAILQANKLNDPEVVRKRSKLMLPPPQISDHELEEIAKMGYASDLLAENEELTEGSAATRALLANYSQTPRQGMTPMRTPQRTPAGKGDAIMMEAENLARLRDSQTPLLGGENPELHPSDFTGVTPRKKEIQTPNPMLTPSMTPGGAGLTPRIGLTPSRDGSSFSMTPKGTPFRDELHINEDMDMQQSAKLERQRREEARRSLRSGLTGLPQPKNEYQIVAQPPPEESEEPEEKIEEDMSDRIAREKAEEEARQQALLKKRSKVLQRDLPRPPAASLAVIRNSLLSADGDKSSVVPPTPIEVADKMVREELLQLLEHDNAKYPLDDKAEKKKGAKNRTNRSASQVLAIDDFDENELQEADKMIKEEGKFLCVSMGHENKTLDDFVEAHNTCVNDLMYFPTRSAYELSSVAGNADKVAAFQEEMENVRKKMEEDEKKAEHMKAKYKTYTKGHERRAETVWTQIEATLKQAEIGGTEVECFKALKRQEEMAASFRKKNLQEEVIKQKETESKLQTRYGNMLAMVEKAEEIMVGFRAQALKKQEDVEDSHKLKEAKLATGEEEDIAIAMEASA

SEQ ID NO: 2261 - DNA, 1182 bp, Arabidopsis thaliana
  G218
atggaggcagagatcgtgagacgatcggaggtaacgggattaagaagggaggtggaagaatcgtcaattggtagaggagattgcgatggtgatggcggcgatgtgggagaagatgcggcagggttcgttgggacgagcgggagaggaagaagagatcgagttaaagggccgtggtcgaaggaggaggatgatgtgttgagtgagctcgttaagaggttgggagcgaggaattggagttttatcgctcggagtattcctggtcgttcaggcaagtcttgtcgtcttcgttggtgtaatcagctcaatccaaatcttatacgcaattcatttactgaggtagaggatcaggctatcatcgcagcacatgccatccacggaaacaaatgggctgttatcgcgaagctcctccccggaagaacagataatgctatcaagaaccactggaactctgctttaagacgtcgattcatagactttgaaaaggccaagaatataggaactggaagcttggtcgtggatgattctggatttgacagaacgacaacagtagcctcatcagaagaaactttatcttcaggcggtggttgccatgtaactactccaattgtatctccagaaggcaaagaagctaccacctccatggaaatgtctgaagaacaatgcgtagagaaaacaaacggagaaggtatttctaggcaagatgataaggatcctccaacgcttttccgcccagtgcctcggctcagttcttttaatgcttgcaatcacatggaaggatcaccctctccacatatacaagaccaaaatcagctccaatcatctaaacaagacgcagcaatgctaagattgcttgaaggagcttacagcgaacggtttgtgcctcaaacatgtggaggtggttgttgcagcaacaatcccgatggcagttttcagcaagaatcattgttgggtccagagtttgtggattacttagactcaccaacgtttccgagttccgaactagctgctatagcaacggaaataggcagcctcgcttggctgagaagcggtttagagagtagcagcgtgagggtgatggaagacgcagttggtcggttaaggcctcaaggctccaggggtcatcgagatcattatcttgtatctgaacaggggacgaacataaccaatgtcctgtccacataa

SEQ ID NO: 2262 - protein, 393 aa, Arabidopsis thaliana
  G218
MEAEIVRRSEVTGLRREVEESSIGRGDCDGDGGDVGEDAAGFVGTSGRGRRDRVKGPWSKEEDDVLSELVKRLGARNWSFIARSIPGRSGKSCRLRWCNQLNPNLIRNSFTEVEDQAIIAAHAIHGNKWAVIAKLLPGRTDNAIKNHWNSALRRRFIDFEKAKNIGTGSLVVDDSGFDRTTTVASSEETLSSGGGCHVTTPIVSPEGKEATTSMEMSEEQCVEKTNGEGISRQDDKDPPTLFRPVPRLSSFNACNHMEGSPSPHIQDQNQLQSSKQDAAMLRLLEGAYSERFVPQTCGGGCCSNNPDGSFQQESLLGPEFVDYLDSPTFPSSELAAIATEIGSLAWLRSGLESSSVRVMEDAVGRLRPQGSRGHRDHYLVSEQGTNITNVLST

SEQ ID NO: 2263 - DNA, 989 bp, Arabidopsis thaliana
  G227
gtaccgtcgacgatccggcgatgtcaaacccgacccgtaagaatatggagaggattaaaggtccatggagtccagaagaagatgatctgttgcagaggcttgttcagaaacatggtccgaggaactggtctttgattagcaaatcaatccctggacgttccggcaaatcttgtcgtctccggtggtgtaaccagctatctccggaggtagagcaccgtgctttttcgcaggaagaagacgagacgattattcgagctcacgctcggtttggtaacaagtgggctacgatctctcgtcttctcaatggacgaaccgataacgctatcaagaatcattggaactcgacgctgaagcgaaaatgcagcgtcgaagggcaaagttgtgattttggtggtaatggagggtatgatggtaatttaggagaagagcaaccgttgaaacgtacggcgagtggtggtggtggtgtctcgactggcttgtatatgagtcccggaagtccatcgggatctgacgtcagcgagcaatctagtggtggtgcacacgtgtttaaaccaacggttagatctgaggttacagcgtcatcgtctggtgaagatcctccaacttatcttagtttgtctcttccttggactgacgagacggttcgagtcaacgagccggttcaacttaaccagaatacggttatggacggtggttatacggcggagctgtttccggttagaaaggaagagcaagtggaagtagaagaagaagaagcgaaggggatatctggtggattcggtggtgagttcatgacggtggttcaggagatgataaggacggaggtgaggagttacatggcggatttacagcgaggaaacgtcggtggtagtagttctggcggcggaggtggcggttcgtgtatgccacaaagtgtaaacagccgtcgtgttgggtttagagagtttatagtgaaccaaatcggaattgggaagatggagtaggcggcc

SEQ ID NO: 2264 - protein, 320 aa, Arabidopsis thaliana
  G227
MSNPTRKNMERIKGPWSPEEDDLLQRLVQKHGPRNWSLISKSIPGRSGKSCRLRWCNQLSPEVEHRAFSQEEDETIIRAHARFGNKWATISRLLNGRTDNAIKNHWNSTLKRKCSVEGQSCDFGGNGGYDGNLGEEQPLKRTASGGGGVSTGLYMSPGSPSGSDVSEQSSGGAHVFKPTVRSEVTASSSGEDPPTYLSLSLPWTDETVRVNEPVQLNQNTVMDGGYTAELFPVRKEEQVEVEEEEAKGISGGFGGEFMTVVQEMIRTEVRSYMADLQRGNVGGSSSGGGGGGSCMPQSVNSRRVGFREFIVNQIGIGKME

SEQ ID NO: 2265 - DNA, 1209 bp, Arabidopsis thaliana
  G229
ttgtggtcagtggaataaacacatataaccgccggagaaaatgggaagagcgccatgttgcgagaaggtcggtatcaagagagggcggtggacggcggaggaggaccagattctctccaactacattcaatccaatggtgaaggttcttggagatctctccccaaaaatgccggattaaaaaggtgtggaaagagctgtagattgagatggataaactatctaagatcagacctcaagcgtggaaacataactccagaagaagaagaactcgttgttaaattgcattccactttgggaaacaggtggtcactaatcgcgggtcatctaccagggagaacagacaacgaaataaaaaattattggaactctcatctcagccgtaaactccacaacttcattaggaagccatccatctctcaagacgtctccgccgtaatcatggcgaacgcttcttcagcgccaccgccgccgcaggcaaaacgcagacttgggagaacgagtaggtccgctatgaaaccaaaaatccgcagaacaaaaactcgtaaaacgaagaaaacgtctgcaccaccggagcctaacgccgatgtagctggggctgataaagaagcattaatggtggagtcaagtggagccgaggctgagctaggacgaccatgtgactactatggagatgattgtaacaaaaatctcatgagcattaatggcgataatggagttttaacgtttgatgatgatatcatcgatcttttgttggacgagtcagatcctggccacttgtacacaaacacaacgtgcggtggtggtggggagttgcataacataagagactctgaaggagccagagggttctcggatacttggaaccaagggaatctcgactgtcttcttcagtcttgtccatctgtggagtcgtttctcaactacgaccaccaagttaacgacgcgtcgacggatgagtttatcgattgggattgtgtttggcaagaaggtagtgataataatctttggcatgagaaagagaatcccgactcaatggtctcgtggcttttagacggtgatgatgaggccacgatcgggaatagtaattgtgagaactttggagaaccgttagatcatgacgacgaaagcgctttggtcgcttggcttctgtcatgatgatattgattgatccgttatgtaatcttttttgtgcattcacagtttgaatc

SEQ ID NO: 2266 - protein, 371 aa, Arabidopsis thaliana
  G229
MGRAPCCEKVGIKRGRWTAEEDQILSNYIQSNGEGSWRSLPKNAGLKRCGKSCRLRWINYLRSDLKRGNITPEEEELVVKLHSTLGNRWSLIAGHLPGRTDNEIKNYWNSHLSRKLHNFIRKPSISQDVSAVIMANASSAPPPPQAKRRLGRTSRSAMKPKIRRTKTRKTKKTSAPPEPNADVAGADKEALMVESSGAEAELGRPCDYYGDDCNKNLMSINGDNGVLTFDDDIIDLLLDESDPGHLYTNTTCGGGGELHNIRDSEGARGFSDTWNQGNLDCLLQSCPSVESFLNYDHQVNDASTDEFIDWDCVWQEGSDNNLWHEKENPDSMVSWLLDGDDEATIGNSNCENFGEPLDHDDESALVAWLLS

SEQ ID NO: 2267 - DNA, 1139 bp, Arabidopsis thaliana
  G234
cacaacatcatacccaccaacatatataatcttgatcatagagagataaacagaggccgctatcaagaacaagactaagaacaagacttcactaggagtacaagtatgggaagagcaccgtgttgtgacaaagcaaacgtgaagaaagggccttggtctcctgaggaagatgcaaaactcaaatcttacattgaaaatagtggcaccggaggcaattggatcgctttgcctcaaaagattggtttaaagagatgtggaaagagttgcaggctgaggtggcttaactatcttagaccaaacatcaaacatggtggcttctctgaggaagaagaaaacatcatttgtagcctttaccttacaattggtagcaggtggtctataatcgctgctcaattgccgggacgaacagacaacgatataaaaaactattggaacacgaggctcaagaagaaactcattaacaaacaacgcaaggagcttcaagaagcttgtatggagcagcaagagatgatggtgatgatgaagagacaacaccaacaacaacaaatccaaacttcttttatgatgagacaagaccaaacaatgttcacatggccactacatcatcataatgttcaagttccagctcttttcagaatcaaaccaactcgttttgcgaccaagaagatgttaagccagtgctcatcaagaacatggtcaagatcgaagatcaagaactggagaaaacaaacctcatcatcatcaagattcaatgacaacgcttttgatcatctctctttctctcaactcttgttagatcctaatcataaccacttaggatcaggagagggtttctccatgaactctatcttgagcgccaacacaaactctccattgcttaacacaagtaatgataatcagtggttcgggaatttccaggccgaaaccgtaaacttgttctcaggagcctccacaagtacttcggcagatcaaagcactataagttgggaagacataagctctcttgtttattctgattcaaagcaatttttttaattataataatatattattcttaagatgaaacgtacatcattattattaattgggggtacgtaacgtatatatggaataacgatctagtttgtttaaatttaaaa

SEQ ID NO: 2268 - protein, 309 aa, Arabidopsis thaliana
  G234
MGRAPCCDKANVKKGPWSPEEDAKLKSYIENSGTGGNWIALPQKIGLKRCGKSCRLRWLNYLRPNIKHGGFSEEEENIICSLYLTIGSRWSIIAAQLPGRTDNDIKNYWNTRLKKKLINKQRKELQEACMEQQEMMVMMKRQHQQQQIQTSFMMRQDQTMFTWPLHHHNVQVPALFRIKPTRFATKKMLSQCSSRTWSRSKIKNWRKQTSSSSRFNDNAFDHLSFSQLLLDPNHNHLGSGEGFSMNSILSANTNSPLLNTSNDNQWFGNFQAETVNLFSGASTSTSADQSTISWEDISSLVYSDSKQFF

SEQ ID NO: 2269 - DNA, 920 bp, Arabidopsis thaliana
  G237
atggcgaagacgaaatatggagagagacataggaaagggttatggtcacctgaagaagacgagaagctaaggagcttcatcctctcttatggccattcttgctggaccactgttcccatcaaagctgggttacaaaggaatgggaagagctgcagattaagatggattaattacctaagaccagggttaaagagggatatgattagtgcagaagaagaagagactatcttgacgtttcattctcccttgggtaacaagtggtcgcaaatagctaaattcttaccgggaagaacagacaatgagataaagaactattggcactctcatttgaaaaagaaatggctcaagtctcagagcttacaagatgcaaaatctatttcccctccttcgtcttcatcatcatcacttgttgcttgtggagaaagaaatccggaaaccttgatctcgaatcacgtgttctccctccagagacttctagagaacaaatcttcatctccctcacaagaaagcaacggaaataacagccatcaatgttcttctgctcctgagattccaaggcttttcttctctgaatggctttcttcttcatatccccacaccgattattcctctgagtttaccgactctaagcacagtcaagctccaaatgtcgaagagactctctcagcttatgaagaaatgggtgatgttgatcagttccattacaacgaaatgatgatcaacaacagcaactggactcttaacgacattgtgtttggttccaaatgtaagaagcaggagcatcatatttatagagaggcttcagattgtaattcttctgctgaattcttttctccaccaacaacgacgtaaattgcgtttattgtaatgtaaatcaaatttctaaggcaaaaccggaaaaaaaaaaaaaaaaaaaaaaa

SEQ ID NO: 2270 - protein, 283 aa, Arabidopsis thaliana
  G237
MAKTKYGERHRKGLWSPEEDEKLRSFILSYGHSCWTTVPIKAGLQRNGKSCRLRWINYLRPGLKRDMISAEEEETILTFHSPLGNKWSQIAKFLPGRTDNEIKNYWHSHLKKKWLKSQSLQDAKSISPPSSSSSSLVACGERNPETLISNHVFSLQRLLENKSSSPSQESNGNNSHQCSSAPEIPRLFFSEWLSSSYPHTDYSSEFTDSKHSQAPNVEETLSAYEEMGDVDQFHYNEMMINNSNWTLNDIVFGSKCKKQEHHIYREASDCNSSAEFFSPPTTT

SEQ ID NO: 2271 - DNA, 1195 bp, Arabidopsis thaliana
  G242
ctctcaaaaccaaaatcactaaagaggagaagattgctaaagtttgataaaacattccaaaatcaatggctgataggatcaaaggtccatggagtcctgaagaagacgagcagcttcgtaggcttgttgttaaatacggtccaagaaactggacagtgattagcaaatctattcccggtagatcggggaaatcgtgtcgtttacggtggtgcaaccagctttcgccgcaagttgagcatcggccgttttcggctgaggaagacgagacgatcgcacgtgctcacgctcagttcgggaataaatgggcgacgattgctcgtcttctcaacggtcgtacggacaacgccgtgaagaatcactggaactcgacgctcaagaggaaatgcggcggttacgaccatcggggttacgatggttcggaggatcatcggccggttaagagatcggtgagtgcgggatctccacctgttgttactgggctttacatgagcccaggaagcccaactggatctgatgtcagtgattcaagtactatcccgatattaccttccgttgagcttttcaagcctgtgcctagacctggtgctgttgtgctaccgcttcctatcgaaacgtcgtctttttccgatgatccaccgacttcgttaagcttgtcacttcctggtgccgacgtaagcgaggagtcaaaccgtagccacgagtcaacgaatatcaacaacaccacttcgagccgccacaaccacaacaatacggtgtcgtttatgccgtttagtggtgggtttagaggtgcgattgaggaaatggggaagtcttttcccggtaacggaggcgagtttatggcggtggtgcaagagatgattaaggcggaagtgaggagttacatgacggagatgcaacggaacaatggtggcggattcgtcggaggattcattgataatggcatgattccgatgagtcaaattggagttgggagaatcgagtagacaaagtgagattattaggaaactgtttaaattggagaagaagaaaaatgctctgtttttttctcctttggattaggcttaagaattttgggttttaaggaaatgtatagaggaaatcgagtgaacaaagctcgagagctggggacgtagtgacgaagacgaagatcaaatttctcttaagctattcaggaaaataaaataaatttttattt

SEQ ID NO: 2272 - protein, 305 aa, Arabidopsis thaliana
  G242
MADRIKGPWSPEEDEQLRRLVVKYGPRNWTVISKSIPGRSGKSCRLRWCNQLSPQVEHRPFSAEEDETIARAHAQFGNKWATIARLLNGRTDNAVKNHWNSTLKRKCGGYDHRGYDGSEDHRPVKRSVSAGSPPVVTGLYMSPGSPTGSDVSDSSTIPILPSVELFKPVPRPGAVVLPLPIETSSFSDDPPTSLSLSLPGADVSEESNRSHESTNINNTTSSRHNHNNTVSFMPFSGGFRGAIEEMGKSFPGNGGEFMAVVQEMIKAEVRSYMTEMQRNNGGGFVGGFIDNGMIPMSQIGVGRIE

SEQ ID NO: 2273 - DNA, 998 bp, Arabidopsis thaliana
  G258
agtgaccaccctgctggttaatcaacaccaagagaccttgtaatatataagttaggaagatgagagagaagtgggaaatgaaaagagatgaaatgggacatcgatgttgtggaaaacacaaagtgaagagaggtctttggtctccagaggaagacgagaagcttcttcgttatatcaccactcatggtcatcctagttggagttccgttccaaagcttgccgggttgcagagatgtgggaagagttgcagattaaggtggataaactatctaaggcctgatctgaggagaggttcgtttaatgaggaagaagagcagattatcatcgacgtacatcgtattcttggtaacaaatgggctcagattgctaagcacttacctggacgcactgataatgaagtcaagaacttttggaactcatgcattaagaagaaacttctttctcaaggcttagatccttctacacataatcttatgccttcacacaaaagatcttcttcttcaaacaataataatatccccaagccaaacaaaacgacgtccatcatgaagaaccctactgatcttgatcaatcaaccactgctttttcaatcacaaacatcaatccacccacttccactaaaccaaacaaacttaaatctcctaaccagactacaatcccatctcaaaccgtgatccctatcaatgataacatgtcaagtactcaaaccatgatccctatcaatgatcccatgtcaagtcttttagatgatgagaatatgattcctcactggtcagatgttgatggaatggcgatccacgaagctccgatgttgcctagtgataaggcagtagtgggagtggatgatgatgatctcaacatggacattttgtttaacactccttcttcttctgcttttgatcctgattttgcttccattttctcctctgcaatgtctatcgatttcaatcccatggatgatcttggcagctggaccttttagcttttactctacagc

SEQ ID NO: 2274 - protein, 307 aa, Arabidopsis thaliana
  G258
MREKWEMKRDEMGHRCCGKHKVKRGLWSPEEDEKLLRYITTHGHPSWSSVPKLAGLQRCGKSCRLRWINYLRPDLRRGSFNEEEEQIIIDVHRILGNKWAQIAKHLPGRTDNEVKNFWNSCIKKKLLSQGLDPSTHNLMPSHKRSSSSNNNNIPKPNKTTSIMKNPTDLDQSTTAFSITNINPPTSTKPNKLKSPNQTTIPSQTVIPINDNMSSTQTMIPINDPMSSLLDDENMIPHWSDVDGMAIHEAPMLPSDKAVVGVDDDDLNMDILFNTPSSSAFDPDFASIFSSAMSIDFNPMDDLGSWTF

SEQ ID NO: 2275 - DNA, 896 bp, Arabidopsis thaliana
  G259
gagatcttctactacttgttttcttcaagaataataattttcgttttatatatggaagatgctggtgaacatttacggtgtaacgataacgttaacgacgaggagcgtttgccattggagtttatgatcggaaactcaacatccacggcggagctacagccgcctccaccgttcttggtaaagacatacaaagtggtggaggatccgacgacggacggggttatatcttggaacgaatacggaactggtttcgtcgtgtggcagccggcagaattcgctagagatctgttaccaacacttttcaagcattgcaacttctctagcttcgttcgccagctcaatacttacggttttcgaaaagtaacgacgataagatgggaatttagtaatgagatgtttcgaaaggggcaaagagagcttatgagcaatatccgaagaaggaagagccaacattggtcacacaacaagtctaatcaccaggttgtaccaacaacaacgatggtgaatcaagaaggtcatcaacggattgggattgatcatcaccatgaggatcaacagtcttccgccacttcatcctctttcgtatacactgcattactcgacgaaaacaaatgcttgaagaatgaaaacgagttattaagctgcgaacttgggaaaaccaagaagaaatgcaagcagcttatggagttggtggagagatacagaggagaagacgaagatgcaactgatgaaagtgatgatgaagaagatgaagggcttaagttgttcggagtaaaacttgaatgaaactagattgctagattgatattcgtaatataccagtttcttcatattcttagaagttttgcataactatatatagtactcttttaagacatgcaagatcagaacatatg

SEQ ID NO: 2276 - protein, 244 aa, Arabidopsis thaliana
  G259
MEDAGEHLRCNDNVNDEERLPLEFMIGNSTSTAELQPPPPFLVKTYKVVEDPTTDGVISWNEYGTGFVVWQPAEFARDLLPTLFKHCNFSSFVRQLNTYGFRKVTTIRWEFSNEMFRKGQRELMSNIRRRKSQHWSHNKSNHQVVPTTTMVNQEGHQRIGIDHHHEDQQSSATSSSFVYTALLDENKCLKNENELLSCELGKTKKKCKQLMELVERYRGEDEDATDESDDEEDEGLKLFGVKLE

SEQ ID NO: 2277 - DNA, 1104 bp, Arabidopsis thaliana
  G263
tttttagttttatttttctgtggtaaaataaaaaaagttcgccggagatgacggctgtgacggcggcgcaaagatcagttccggcgccgtttttaagcaaaacgtatcagctagttgatgatcatagcacagacgacgtcgtttcatggaacgaagaaggaacagcttttgtcgtgtggaaaacagcagagtttgctaaagatcttcttcctcaatacttcaagcataataatttctcaagcttcattcgtcagctcaacacttacggatttcgtaaaactgtaccggataaatgggaatttgcaaacgattatttccggagaggcggggaggatctgttgacggacatacgacggcgtaaatcggtgattgcttcaacggcggggaaatgtgttgttgttggttcgccttctgagtctaattctggtggtggtgatgatcacggttcaagctccacgtcatcacccggttcgtcgaagaatcctggttcggtggagaacatggttgctgatttatcaggagagaacgagaagcttaaacgtgaaaacaataacttgagctcggagctcgcggcggcgaagaagcagcgcgatgagctagtgacgttcttgacgggtcatctgaaagtaagaccggaacaaatcgataaaatgatcaaaggagggaaatttaaaccggtggagtctgacgaagagagtgagtgcgaaggttgcgacggcggcggaggagcagaggagggggtaggtgaaggattgaaattgtttggggtgtggttgaaaggagagagaaaaaagagggaccgggatgaaaagaattatgtggtgagtgggtcccgtatgacggaaataaagaacgtggactttcacgcgccgttgtggaaaagcagcaaagtctgcaactaaaaaaagagtagaagactgttcaaaccagcgtgtgacacgtcatcgacgacgacgaaaaaaatgatttaaaaaactatttttttccgtaaggaagaaaagttatttttatgttttaaaaaggtgaagaaggtccagaaggatcaacgcaaatatataaatggattttcatgtattatataatttaattagtgtattaagaaaa

SEQ ID NO: 2278 - protein, 284 aa, Arabidopsis thaliana
  G263
MTAVTAAQRSVPAPFLSKTYQLVDDHSTDDVVSWNEEGTAFVVWKTAEFAKDLLPQYFKHNNFSSFIRQLNTYGFRKTVPDKWEFANDYFRRGGEDLLTDIRRRKSVIASTAGKCVVVGSPSESNSGGGDDHGSSSTSSPGSSKNPGSVENMVADLSGENEKLKRENNNLSSELAAAKKQRDELVTFLTGHLKVRPEQIDKMIKGGKFKPVESDEESECEGCDGGGGAEEGVGEGLKLFGVWLKGERKKRDRDEKNYVVSGSRMTEIKNVDFHAPLWKSSKVCN

SEQ ID NO: 2279 - DNA, 1613 bp, Arabidopsis thaliana
  G264
cttgtaccagtttctgattagattcaacaatgaacggcgcattaggtaactcctccgcctccgttagcggcggagaaggagccggaggaccagcgcctttcttggtgaaaacctacgagatggtcgacgattcatcaacggaccagatcgtatcgtggagcgctaacaacaacagcttcatcgtttggaatcatgccgaattttcacgcctccttcttccaacctacttcaaacacaataacttctcttccttcattcgtcagctcaatacctatgggtttaggaagattgatccagagaggtgggagtttttgaatgatgattttattaaggatcagaagcatcttctcaagaatatacatagaaggaaacctatacacagccacagtcatccacctgcttcgtcgactgatcaagaaagagcagtgttgcaagagcaaatggacaagctttcacgtgagaaagctgcaattgaagctaagcttttaaagttcaaacaacagaaggttgtagcaaagcatcagtttgaagaaatgactgagcatgttgatgatatggagaataggcagaagaagctgctgaattttttggaaactgcgattcggaatcctacttttgttaagaattttggtaagaaagtcgagcagttggatatttcagcttacaacaaaaagcgaaggctccctgaagttgagcaatcaaagccaccttcagaagattctcatctggataatagtagtggtagctcgagacgcgagtctggaaacatttttcatcaaaatttctctaataaattgcgactagagctttctccagctgattcagatatgaacatggtttcacacagtatacaaagttccaatgaagaaggtgcgagtcccaaagggatactgtcaggaggtgatccaaatactacactaacaaaaagagaaggcctaccatttgcacctgaagctctagagcttgcggataccgggacatgcccgaggagattactgttaaatgataatacaagggtggagaccttgcagcagaggctaacttcttcagaggagactgatggtagcttttcatgtcatttaaatctaaccctggcttctgctccgttaccggacaaaacagcttcacagatagctaagacgactcttaaaagtcaggagttaaactttaactcaatagaaacaagtgcaagtgagaaaaatcggggtagacaagagattgcagttggaggtagccaagcaaatgcagctcctccagcaagagtgaatgatgtattctgggaacagttcctaacagaaaggccagggtcttcagataatgaggaggcaagttcgacttatagaggtaacccatacgaagagcaagaggagaaaagaaacgggagtatgatgttacgtaatacaaagaatatcgagcagctgaccttataaactatttggacggttacatcaacgagagtacgaactgaggttttggtaagaagtatgggtgagtaagtaatgaaacattggactgaaaaagcgtaagtagctttgttgtaaacacttgcgtctctgtctacacaagtaatttgactgtaaatgtaagtgtacaggatttaaattgaataagca

SEQ ID NO: 2280 - protein, 466 aa, Arabidopsis thaliana
  G264
MNGALGNSSASVSGGEGAGGPAPFLVKTYEMVDDSSTDQIVSWSANNNSFIVWNHAEFSRLLLPTYFKHNNFSSFIRQLNTYGFRKIDPERWEFLNDDFIKDQKHLLKNIHRRKPIHSHSHPPASSTDQERAVLQEQMDKLSREKAAIEAKLLKFKQQKVVAKHQFEEMTEHVDDMENRQKKLLNFLETAIRNPTFVKNFGKKVEQLDISAYNKKRRLPEVEQSKPPSEDSHLDNSSGSSRRESGNIFHQNFSNKLRLELSPADSDMNMVSHSIQSSNEEGASPKGILSGGDPNTTLTKREGLPFAPEALELADTGTCPRRLLLNDNTRVETLQQRLTSSEETDGSFSCHLNLTLASAPLPDKTASQIAKTTLKSQELNFNSIETSASEKNRGRQEIAVGGSQANAAPPARVNDVFWEQFLTERPGSSDNEEASSTYRGNPYEEQEEKRNGSMMLRNTKNIEQLTL

SEQ ID NO: 2281 - DNA, 1470 bp, Arabidopsis thaliana
  G265
ctttggtcttggaagccaaatcaaacctttccttcaatcctcaaattttcgaaaattttctcttttgctttacgttctctcaattcttatttgtaagaaagtttgttcctttaatcaatcaaatcaaagagacttttgaagattgtttcccaatttgcgtcaatcgggatcgagtcaaatctgaaatcttctccactcatcatctgactataagacttaatcaagggactttttgttcgggtttggttttaaacgtcttggattcgaagtggttaaggtatggatgaaaataatggaggttcaagctcacttccacctttccttactaaaacatatgaaatggttgatgattcttcttctgactcggtcgttgcttggagcgaaaacaacaaaagcttcatcgtcaagaatccagcagagttttcaagagaccttcttccgagattcttcaagcataagaatttctcaagtttcatccgtcagcttaatacatatggttttcgaaaagtagatcctgagaaatgggaattcttgaatgatgattttgttagaggtcgaccttaccttatgaagaacattcatagacgaaaaccggttcatagccactcgttagtgaatctacaagcgcaaaatcctttgacggaatcagaaagacggagcatggaggatcagatagaaagactgaaaaatgagaaagaaggccttcttgcggagttacagaaccaagagcaagaacggaaagagtttgagctgcaagtaacgacattgaaagatcggttacaacatatggaacaacatcagaaatcaatagtggcatatgtttcacaggttttgggaaaaccaggactttcactaaacctcgaaaaccatgagagaagaaaaagaagatttcaagagaactctcttcctccaagcagttcacacatagaacaggtcgaaaagttagaatcttcgctaacgttttgggagaatcttgtatcggaatcatgcgagaagagcggtttgcagtcatcaagcatggatcatgatgcagctgagtcaagtctaagtattggcgatacacgacccaaatcatcgaagattgatatgaactcagagccgcccgttaccgttactgcgcctgctccaaaaacaggcgttaacgatgacttttgggaacaatgtttgacagagaaccctggatcaaccgagcaacaagaagttcagtcagagagaagagatgtcggtaatgataataatggtaataagattggaaatcaaaggacgtattggtggaattcagggaatgtaaataacattacagagaaagcttcttgacatgaatgaggtttttgtaaaatagttttcttttggttccactgagattattgtatgtgttcattatttattactctgtttctgtaaaaacaaatctctctattgtttgaggcaggagtgacataaatgcatatgcagaattggtttcaaaaa

SEQ ID NO: 2282 - protein, 345 aa, Arabidopsis thaliana
  G265
MDENNGGSSSLPPFLTKTYEMVDDSSSDSVVAWSENNKSFIVKNPAEFSRDLLPRFFKHKNFSSFIRQLNTYGFRKVDPEKWEFLNDDFVRGRPYLMKNIHRRKPVHSHSLVNLQAQNPLTESERRSMEDQIERLKNEKEGLLAELQNQEQERKEFELQVTTLKDRLQHMEQHQKSIVAYVSQVLGKPGLSLNLENHERRKRRFQENSLPPSSSHIEQVEKLESSLTFWENLVSESCEKSGLQSSSMDHDAAESSLSIGDTRPKSSKIDMNSEPPVTVTAPAPKTGVNDDFWEQCLTENPGSTEQQEVQSERRDVGNDNNGNKIGNQRTYWWNSGNVNNITEKAS

SEQ ID NO: 2283 - DNA, 2330 bp, Arabidopsis thaliana
  G274
agctttatactttctggctactgcaagctcatcagtgaaaagagcttaaaccagagagatctgataagagaaattttagagtctctctgcttcaacaagatctacatcgaccaggagattagaaagaatcatgggttctaagcataacccaccagggaataacagatcgagaagtacactatctctactcgttgtggttggtttatgttgtttcttctatcttcttggagcatggcaaaagagtgggtttggtaaaggagatagcatagctatggagattacaaagcaagcgcagtgtactgacattgtcactgatcttgattttgaacctcatcacaacacagtgaagatcccacataaagctgatcccaaacctgtttctttcaaaccgtgtgatgtgaagctcaaggattacacgccttgtcaagagcaagaccgagctatgaagttcccgagagagaacatgatttacagagagagacattgtcctcctgataatgagaagctgcgttgtcttgttccagctcctaaagggtatatgactcctttcccttggcctaaaagcagagattatgttcactatgctaatgctcctttcaagagcttgactgtcgaaaaagctggacagaattgggttcagtttcaagggaatgtgtttaaattccctggtggaggaactatgtttcctcaaggtgctgatgcgtatattgaagagctagcttctgttatccctatcaaagatggctctgttagaaccgcattggacactggatgtggggttgctagttggggtgcttatatgcttaagaggaatgttttgactatgtcgtttgcgccaagggataaccacgaagcacaagtccagtttgcgcttgagagaggtgttccagcgattatcgctgttcttggatcaatccttcttccttaccctgcaagagcctttgacatggctcaatgctctcgatgcttgataccatggaccgcaaacgagggaacatacttaatggaagtagatagagtcttgagacctggaggttactgggtcttatcgggtcctccaatcaactggaagacatggcacaagacgtggaaccgaactaaagcagagctaaatgccgagcaaaagagaatagagggaatcgcagagtccttatgctgggagaagaagtatgagaagggagacattgcaattttcagaaagaaaataaacgatagatcatgcgatagatcaacaccggttgacacctgcaaaagaaaggacactgacgatgtctggtacaaggagatagaaacgtgtgtaacaccattccctaaagtatcaaacgaagaagaagttgctggaggaaagctaaagaagttccccgagaggctattcgcagtgcctccaagtatctctaaaggtttgattaatggcgtcgacgaggaatcataccaagaagacatcaatctatggaagaagcgagtgaccggatacaagagaattaacagactgataggttccaccagataccgtaatgtgatggatatgaacgccggtcttggtggattcgctgctgcgcttgaatcgcctaaatcgtgggttatgaatgtgattccaaccattaacaagaacacattgagtgttgtttatgagagaggtctcattggtatctatcatgactggtgtgaaggcttttcaacttatccaagaacatacgatttcattcacgctagtggtgtcttcagcttgtatcagcacagctgcaaacttgaggatattcttcttgaaactgatcggattttacgaccggaagggattgtgattttccgggatgaggttgatgttttgaatgatgtgaggaagatcgttgatggaatgagatgggatactaagttaatggatcatgaagacggtcctctcgtgccggagaagattcttgtcgccacgaagcagtattgggtagccggcgacgatggaaacaattctccgtcgtcttctaatagtgaagaagaataaaacaaaaacaaaaaactcctcaggttactaagcttgaagtgtagatctattttacaacatctggaaaattcttatcaaaaaaggaaggaatcagaatttccattaaagaaaggtgtcaaaaaaaagttgtaaaactatatagtagtgatcaagacgaatatgtgcatttatgttttatttttgttccctagtttttaattttatttttttgaaggaagaaaaaattagttccatgtgtttttgcaagatagttgaaaccttggacgcttgttatgtatgatgcgatcttgacattttttaataacagttattttaaataaatttatgatataaa

SEQ ID NO: 2284 - protein, 621 aa, Arabidopsis thaliana
  G274
MGSKHNPPGNNRSRSTLSLLVVVGLCCFFYLLGAWQKSGFGKGDSIAMEITKQAQCTDIVTDLDFEPHHNTVKIPHKADPKPVSFKPCDVKLKDYTPCQEQDRAMKFPRENMIYRERHCPPDNEKLRCLVPAPKGYMTPFPWPKSRDYVHYANAPFKSLTVEKAGQNWVQFQGNVFKFPGGGTMFPQGADAYIEELASVIPIKDGSVRTALDTGCGVASWGAYMLKRNVLTMSFAPRDNHEAQVQFALERGVPAIIAVLGSILLPYPARAFDMAQCSRCLIPWTANEGTYLMEVDRVLRPGGYWVLSGPPINWKTWHKTWNRTKAELNAEQKRIEGIAESLCWEKKYEKGDIAIFRKKINDRSCDRSTPVDTCKRKDTDDVWYKEIETCVTPFPKVSNEEEVAGGKLKKFPERLFAVPPSISKGLINGVDEESYQEDINLWKKRVTGYKRINRLIGSTRYRNVMDMNAGLGGFAAALESPKSWVMNVIPTINKNTLSVVYERGLIGIYHDWCEGFSTYPRTYDFIHASGVFSLYQHSCKLEDILLETDRILRPEGIVIFRDEVDVLNDVRKIVDGMRWDTKLMDHEDGPLVPEKILVATKQYWVAGDDGNNSPSSSNSEEE

SEQ ID NO: 2285 - DNA, 983 bp, Arabidopsis thaliana
  G280
aagttaatatgagaataatgagaaaaccactttcccaaattgctttttaaaatccctcctcacacagattccttccttcatcacctcacacactctctacgcttgacatggccttcgatctccaccatggctcagcttcagatacgcattcatcagaacttccgtcgttttctctcccaccttatcctcagatgataatggaagcgattgagtccttgaacgataagaacggctgcaacaaaacgacgattgctaagcacatcgagtcgactcaacaaactctaccgccgtcacacatgacgctgctcagctaccatctcaaccagatgaagaaaaccggtcagctaatcatggtgaagaacaattatatgaaaccagatccagatgctcctcctaagcgtggtcgtggccgtcctccgaagcagaagactcaggccgaatctgacgccgctgctgctgctgttgttgctgccaccgtcgtctctacagatccgcctagatctcgtggccgtccaccgaagccgaaagatccatcggagcctccccaggagaaggtcattaccggatctggaaggccacgaggacgaccaccgaagagaccgagaacagattcggagacggttgctgcgccggaaccggcagctcaggcgacaggtgagcgtaggggacgtgggagacctccgaaggtgaagccgacggtggttgctccggttgggtgctgaattaatcggtacttatgcaatttcggaatctttagttactgaaaaatggaatctcttagagagtaagagagtgctttaatttagcttaattagatttatttggatttctttcagtatttggattgtaaactttagaatttgtgtgtgtgttgttgcttagtcctgagataagatataacattagcgactgtgtattattattattactgcattgtgttatgtgaaactttgttctcttgttgaaaaaaaaaaaaaaaaaaa

SEQ ID NO: 2286 - protein, 204 aa, Arabidopsis thaliana
  G280
MAFDLHHGSASDTHSSELPSFSLPPYPQMIMEAIESLNDKNGCNKTTIAKHIESTQQTLPPSHMTLLSYHLNQMKKTGQLIMVKNNYMKPDPDAPPKRGRGRPPKQKTQAESDAAAAAVVAATVVSTDPPRSRGRPPKPKDPSEPPQEKVITGSGRPRGRPPKRPRTDSETVAAPEPAAQATGERRGRGRPPKVKPTVVAPVGC

SEQ ID NO: 2287 - DNA, 2956 bp, Arabidopsis thaliana
  G286
tgcaatttctctcgaccaaaaccctaatttcaggtttggggttttccttctttcactgtcaattttgatgaaacttgtgattcagtgattagaatgaatgctaatgagcaaactcgatccgccaatggcattggcaatggcaatggtgagtctattcccgggattccagatgacttacggtgcaagagatcggatggtaaacagtggagatgcactgcaatgtccatggctgataagactgtttgtgagaagcactacatccaagcaaagaagcgggcggctaattctgctttcagggcgaaccagaagaaagcgaaaaggcgatcatcgttaggcgaaacagatacgtattcggaagggaagatggatgatttcgagttaccagtcaccagcattgaccactataataacggtcttgcctctgcttccaagagtaatggtagactagagaagagacataataaaagcctgatgcggtactcgcccgagacaccgatgatgaggagtttctctccacgtgttgcagtggatttgaatgatgacttgggtagagatgttgtaatgtttgaagagggctacagatcttataggacaccaccatctgttgctgttatggatccgacacgaaacagatcacaccaaagcaccagtcctatggaatactcagcagcaagcacagatgtgtctgcagagtctttgggggaaatctgccatcaatgccagagaaaagatagagagagaatcatttcttgcctcaaatgcaatcaaagagccttctgccacaattgtctatcggcaaggtactcggagatatcacttgaagaagtcgagaaagtttgccctgcatgtcgtggcttgtgtgattgcaaatcttgcctgcgttcagataatacaataaaggttcggatccgggaaatacccgttttggacaagttgcagtatctttatcgtctattatcagctgtcctaccagtcataaagcagatccatcttgaacaatgtatggaagttgaactagagaagaggcttcttgaagttgagattgatcttgtcagggcaagattgaaagcagatgagcagatgtgctgcaacgtgtgtcggataccagttgttgactactaccgtcactgtccgaactgctcatatgacctttgcctgagatgctgtcaagatctacgggaagagtcttcagtgacgattagtgggactaaccaaaacgtacaagatagaaaaggagctcccaaactaaaactaaacttttcatacaagtttcctgagtgggaagccaacggtgatgggagcatcccttgccctcctaaggagtatggaggctgcggttcacattctttgaatcttgcccgcattttcaagatgaattgggttgcaaagcttgtgaaaaatgctgaggagattgttagtggctgcaaattatctgatcttctgaaccctgatatgtgtgattcaagattctgcaaatttgctgagagagaagagagcggtgacaactacgtgtacagcccgtcgcttgaaacgattaaaactgatggagtagctaagtttgagcaacaatgggcagagggtcggcttgttactgtgaaaatggtacttgatgactcatcttgctctagatgggatcctgagactatttggagggatatagacgagctttcggacgagaaactgagagaacatgatccattcttgaaggccattaattgcttggatggtttagaggttgatgtaagacttggggagtttacaagagcatataaagatggaaagaaccaagagacaggtcttccgctattgtggaagttaaaggactggccgagcccaagtgcttccgaggagttcattttctaccaaagacctgagtttatcagaagttttccgtttctcgagtacattcatccccggttaggccttctgaatgttgcagccaagttacctcattactcgctccaaaacgattcaggtccaaagatttatgtgtcttgtgggacgtaccaagaaatcagtgctggcgattcattgactggtattcactacaacatgcgtgacatggtatacctattggtgcacacgtctgaagaaacaacattcgaaagggtgagaaaaacaaaacctgttccagaggaacctgaccagaagatgagcgaaaatgagtcacttcttagccctgagcagaaattaagggacggagagttacatgatctatcacttggtgaagccagtatggagaagaatgaacctgagttggcgttgactgtgaatccagagaacttaacggaaaacggtgacaacatggaatcttcttgcacatcttcatgtgcaggaggagcccagtgggatgtctttcgacgccaagacgtcccaaagttgtccgggtatttgcagagaacattccagaagcctgataatatccagactgattttgtaagccgtacctgctaattcaaataaatgaagtgtgtaaagtcttgtatgtggaatgattgagtttcctagtttgtttactctggtttcaggtgtcacgcccgttgtatgaaggattgtctttaaatgaacaccacaagagacaactaagagacgagtttggagttgagccatggacatttgagcaacatcgtggtgaggctatcttcattccggctggatgtccgttccaaatcactaatcttcagtcgaatattcaggtggcacttgacttcttgtgccctgaaagcgttggagagtcagcaagactagctgaagaaatccggtgtttaccaaacgaccacgaggcaaaacttcagattctagagattggaaagatatcattatacgcagctagctcagccattaaagaggttcagaaactggtcttggatccaaagtttggagcagagcttggatttgaagactctaacttaaccaaagcagtctctcacaacttagacgaggcaaccaagcggcc

SEQ ID NO: 2288 - protein, 786 aa, Arabidopsis thaliana
  G286
MNANEQTRSANGIGNGNGESIPGIPDDLRCKRSDGKQWRCTAMSMADKTVCEKHYIQAKKRAANSAFRANQKKAKRRSSLGETDTYSEGKMDDFELPVTSIDHYNNGLASASKSNGRLEKRHNKSLMRYSPETPMMRSFSPRVAVDLNDDLGRDVVMFEEGYRSYRTPPSVAVMDPTRNRSHQSTSPMEYSAASTDVSAESLGEICHQCQRKDRERIISCLKCNQRAFCHNCLSARYSEISLEEVEKVCPACRGLCDCKSCLRSDNTIKVRIREIPVLDKLQYLYRLLSAVLPVIKQIHLEQCMEVELEKRLLEVEIDLVRARLKADEQMCCNVCRIPVVDYYRHCPNCSYDLCLRCCQDLREESSVTISGTNQNVQDRKGAPKLKLNFSYKFPEWEANGDGSIPCPPKEYGGCGSHSLNLARIFKMNWVAKLVKNAEEIVSGCKLSDLLNPDMCDSRFCKFAEREESGDNYVYSPSLETIKTDGVAKFEQQWAEGRLVTVKMVLDDSSCSRWDPETIWRDIDELSDEKLREHDPFLKAINCLDGLEVDVRLGEFTRAYKDGKNQETGLPLLWKLKDWPSPSASEEFIFYQRPEFIRSFPFLEYIHPRLGLLNVAAKLPHYSLQNDSGPKIYVSCGTYQEISAGDSLTGIHYNMRDMVYLLVHTSEETTFERVRKTKPVPEEPDQKMSENESLLSPEQKLRDGELHDLSLGEASMEKNEPELALTVNPENLTENGDNMESSCTSSCAGGAQWDVFRRQDVPKLSGYLQRTFQKPDNIQTDFVSRTC

SEQ ID NO: 2289 - DNA, 1951 bp, Arabidopsis thaliana
  G308
agtaatttagttttttttttttttttttacaatttattttgttattagaagtggtagtggagtgaaaaaacaaatcctaagcagtcctaaccgatccccgaagctaaagattcttcaccttcccaaataaagcaaaacctagatccgacattgaaggaaaaaccttttagatccatctctgaaaaaaacccaaccatgaagagagatcatcatcatcatcatcaagataagaagactatgatgatgaatgaagaagacgacggtaacggcatggatgagcttctagctgttcttggttacaaggttaggtcatcggaaatggctgatgttgctcagaaactcgagcagcttgaagttatgatgtctaatgttcaagaagacgatctttctcaactcgctactgagactgttcactataatccggcggagctttacacgtggcttgattctatgctcaccgaccttaatcctccgtcgtctaacgccgagtacgatcttaaagctattcccggtgacgcgattctcaatcagttcgctatcgattcggcttcttcgtctaaccaaggcggcggaggagatacgtatactacaaacaagcggttgaaatgctcaaacggcgtcgtggaaaccaccacagcgacggctgagtcaactcggcatgttgtcctggttgactcgcaggagaacggtgtgcgtctcgttcacgcgcttttggcttgcgctgaagctgttcagaaggagaatctgactgtggcggaagctctggtgaagcaaatcggattcttagctgtttctcaaatcggagctatgagacaagtcgctacttacttcgccgaagctctcgcgcggcggatttaccgtctctctccgtcgcagagtccaatcgaccactctctctccgatactcttcagatgcacttctacgagacttgtccttatctcaagttcgctcacttcacggcgaatcaagcgattctcgaagcttttcaagggaagaaaagagttcatgtcattgatttctctatgagtcaaggtcttcaatggccggcgcttatgcaggctcttgcgcttcgacctggtggtcctcctgttttccggttaaccggaattggtccaccggcaccggataatttcgattatcttcatgaagttgggtgtaagctggctcatttagctgaggcgattcacgttgagtttgagtacagaggatttgtggctaacactttagctgatcttgatgcttcgatgcttgagcttagaccaagtgagattgaatctgttgcggttaactctgttttcgagcttcacaagctcttgggacgacctggtgcgatcgataaggttcttggtgtggtgaatcagattaaaccggagattttcactgtggttgagcaggaatcgaaccataatagtccgattttcttagatcggtttactgagtcgttgcattattactcgacgttgtttgactcgttggaaggtgtaccgagtggtcaagacaaggtcatgtcggaggtttacttgggtaaacagatctgcaacgttgtggcttgtgatggacctgaccgagttgagcgtcatgaaacgttgagtcagtggaggaaccggttcgggtctgctgggtttgcggctgcacatattggttcgaatgcgtttaagcaagcgagtatgcttttggctctgttcaacggcggtgagggttatcgggtggaggagagtgacggctgtctcatgttgggttggcacacacgaccgctcatagccacctcggcttggaaactctccaccaattagatggtggctcaatgaattgatctgttgaaccggttatgatgatagatttccgaccgaagccaaactaaatcctactgtttttccctttgtcacttgttaagatcttatctttcattatattaggtaattgaaaaattttaatctcgcctaaattact

SEQ ID NO: 2290 - protein, 532 aa, Arabidopsis thaliana
  G308
MKRDHHHHHQDKKTMMMNEEDDGNGMDELLAVLGYKVRSSEMADVAQKLEQLEVMMSNVQEDDLSQLATETVHYNPAELYTWLDSMLTDLNPPSSNAEYDLKAIPGDAILNQFAIDSASSSNQGGGGDTYTTNKRLKCSNGVVETTTATAESTRHVVLVDSQENGVRLVHALLACAEAVQKENLTVAEALVKQIGFLAVSQIGAMRQVATYFAEALARRIYRLSPSQSPIDHSLSDTLQMHFYETCPYLKFAHFTANQAILEAFQGKKRVHVIDFSMSQGLQWPALMQALALRPGGPPVFRLTGIGPPAPDNFDYLHEVGCKLAHLAEAIHVEFEYRGFVANTLADLDASMLELRPSEIESVAVNSVFELHKLLGRPGAIDKVLGVVNQIKPEIFTVVEQESNHNSPIFLDRFTESLHYYSTLFDSLEGVPSGQDKVMSEVYLGKQICNVVACDGPDRVERHETLSQWRNRFGSAGFAAAHIGSNAFKQASMLLALFNGGEGYRVEESDGCLMLGWHTRPLIATSAWKLSTN

SEQ ID NO: 2291 - DNA, 871 bp, Arabidopsis thaliana
  G323
ctgctcatatcagccattgacacagttgctttgggtttccctcaaacggcgccgattgtctggattttgaccactgatggccttagatcaatcttttgaagatgctgctttacttggagaactctatggagaaggtgcattttgtttcaagagcaagaaacctgaacccattacagtctcggttccttctgatgatactgatgattcgaattttgactgcaatatttgcttagactcggtgcaagaacctgttgtgactctctgtggtcacctcttttgctggccttgtattcacaaatggcttgatgtacagagcttctcaacaagtgatgaataccaaagacatagacagtgtcctgtttgtaaatctaaagtttctcattctactttggttcctttgtatggtagaggccgttgtactactcaggaggaaggtaaaaacagtgtgcctaaaagacccgtaggaccggtttatcggcttgaaatgccgaattcaccttatgcaagtactgatctgcggttatcacaacgggttcatttcaatagcccacaggaaggttactaccctgtctcaggggtgatgagctcgaacagtttatcatactctgctgttttggatccggtgatggtgatggttggagaaatggtagctacgaggttgtttggaacacgagtgatggatagatttgcgtatccggacacttacaatctcgcagggactagcgggccgaggatgagaaggcggataatgcaggcagataaatcgctgggaagaatcttcttcttctttatgtgttgtgttgttctgtgtcttctcttgttttaggttttcatagctagcttggttctgctactgttcagtttcttcagg

SEQ ID NO: 2292 - protein, 249 aa, Arabidopsis thaliana
  G323
MALDQSFEDAALLGELYGEGAFCFKSKKPEPITVSVPSDDTDDSNFDCNICLDSVQEPVVTLCGHLFCWPCIHKWLDVQSFSTSDEYQRHRQCPVCKSKVSHSTLVPLYGRGRCTTQEEGKNSVPKRPVGPVYRLEMPNSPYASTDLRLSQRVHFNSPQEGYYPVSGVMSSNSLSYSAVLDPVMVMVGEMVATRLFGTRVMDRFAYPDTYNLAGTSGPRMRRRIMQADKSLGRIFFFFMCCVVLCLLLF

SEQ ID NO: 2293 - DNA, 1038 bp, Arabidopsis thaliana
  G340
atgaaatctctgtagtttttttttgttcctttcttaaatttcgaaagaaagacatttattaaaccaaaataactctttagatcattgcaaggaaaaatgttgaaaagtgcaagtccaatggcattctacgatatcggagagcagcaatactctactttcgggtacattttaagcaaacctgggaacgcaggagcttacgagattgacccttcgatcccaaacatcgacgatgcgatctacggctcagatgagttccgtatgtacgcttacaaaatcaaacggtgtcctcgtactcgtagccacgactggacggagtgtccctacgctcaccgtggcgagaaagccacacgccgtgatcctcgccgttacacttactgtgcagtcgcatgcccggctttccgaaatggcgcatgccaccgtggcgactcatgcgaattcgcacatggcgtattcgagtactggctccacccggcgcgttaccgaacacgcgcatgtaacgccgggaacttgtgtcagaggaaagtgtgtttctttgcccacgcgccggagcagctaaggcagtctgaaggaaagcacaggtgcaggtacgcatataggccggtgagggctagaggtggtggaaacggcgatggagtgacgatgagaatggacgacgagggttacgacacgtcacggtctccggtgagaagcgggaaagatgatttagatagtaacgaggagaaggtgttgttgaagtgttggagtcggatgagcattgtggatgatcattatgagccgtccgatttggatttggatttgtcacactttgattggatctcagagttggtcgattaaatttgggaaatcaaagcagagaacaaaagaaacccgataaataaagtggattttgttaaaatccacaagatcaagattcaagatgagagatcttgtcatgtatatggtaaatttaattgtaatgatttattgcaatgtcgcaaaagaagttacttctctttgcatgtaaacagattcttgatcttctataagtctttgtattaa

SEQ ID NO: 2294 - protein, 245 aa, Arabidopsis thaliana
  G340
MLKSASPMAFYDIGEQQYSTFGYILSKPGNAGAYEIDPSIPNIDDAIYGSDEFRMYAYKIKRCPRTRSHDWTECPYAHRGEKATRRDPRRYTYCAVACPAFRNGACHRGDSCEFAHGVFEYWLHPARYRTRACNAGNLCQRKVCFFAHAPEQLRQSEGKHRCRYAYRPVRARGGGNGDGVTMRMDDEGYDTSRSPVRSGKDDLDSNEEKVLLKCWSRMSIVDDHYEPSDLDLDLSHFDWISELVD

SEQ ID NO: 2295 - DNA, 570 bp, Arabidopsis thaliana
  G347
atgaaagtagcagatatgcaggaccagctggtgtgtcatggttgtaggaatttattgatgtatcctagaggagcatctaatgtgcgttgtgcgttatgtaacactatcaacatggttcctcctcctcctccacctcacgacatggcacacattatatgtggtggttgtagaacaatgcttatgtatacgcgtggggctagtagcgtaagatgctcttgctgtcaaactacgaaccttgtgccagcgcactccaatcaggttgcccatgctccttccagtcaggttgcgcagatcaattgtgggcattgtcggacgaccctcatgtatccttacggtgcatcatccgtcaaatgcgctgtttgtcaattcgtaactaacgttaatatgagcaatggaagggtacctctcccaactaaccggccaaatggaacagcttgtcccccctctacatcaacttcaacaccaccctctcagacccaaaccgttgttgtagaaaaccccatgtccgttgatgaaagcggaaagttggtgagcaatgttgttgttggagtgacaactgacaaaaagtaa

SEQ ID NO: 2296 - protein, 189 aa, Arabidopsis thaliana
  G347
MKVADMQDQLVCHGCRNLLMYPRGASNVRCALCNTINMVPPPPPPHDMAHIICGGCRTMLMYTRGASSVRCSCCQTTNLVPAHSNQVAHAPSSQVAQINCGHCRTTLMYPYGASSVKCAVCQFVTNVNMSNGRVPLPTNRPNGTACPPSTSTSTPPSQTQTVVVENPMSVDESGKLVSNVVVGVTTDKK

SEQ ID NO: 2297 - DNA, 817 bp, Arabidopsis thaliana
  G352
aatacaccacacacttcactctttcttcatcttcttcttcttaaatagctcgaaatcacatctcacagaattaaatcttatggctctcgagactctcaattctccaacagctaccaccaccgctcggcctcttctccggtatcgtgaagaaatggagcctgagaatctcgagcaatgggctaaaagaaaacgaacaaaacgtcaacgttttgatcacggtcatcagaatcaagaaacgaacaagaaccttccttctgaagaagagtatctcgctctttgtctcctcatgctcgctcgtggctccgccgtacaatctcctcctcttcctcctctaccgtcacgtgcgtcaccgtccgatcaccgagattacaagtgtacggtctgtgggaagtccttttcgtcataccaagccttaggtggacacaagacgagtcaccggaaaccgacgaacactagtatcacttccggtaaccaagaactgtctaataacagtcacagtaacagcggttccgttgttattaacgttaccgtgaacactggtaacggtgttagtcaaagcggaaagattcacacttgctcaatctgtttcaagtcgtttgcgtctggtcaagccttaggtggacacaaacggtgtcactatgacggtggcaacaacggtaacggtaacggaagtagcagcaacagcgtagaactcgtcgctggtagtgacgtcagcgatgttgataatgagagatggtccgaagaaagtgcgatcggtggccaccgtggatttgacctaaacttaccggctgatcaagtctcagtgacgacttcttaa

SEQ ID NO: 2298 - protein, 245 aa, Arabidopsis thaliana
  G352
MALETLNSPTATTTARPLLRYREEMEPENLEQWAKRKRTKRQRFDHGHQNQETNKNLPSEEEYLALCLLMLARGSAVQSPPLPPLPSRASPSDHRDYKCTVCGKSFSSYQALGGHKTSHRKPTNTSITSGNQELSNNSHSNSGSVVINVTVNTGNGVSQSGKIHTCSICFKSFASGQALGGHKRCHYDGGNNGNGNGSSSNSVELVAGSDVSDVDNERWSEESAIGGHRGFDLNLPADQVSVTTS

SEQ ID NO: 2299 - DNA, 615 bp, Arabidopsis thaliana
  G357
atgcagaacaaacacaaatgcaagctctgttccaagagtttctgtaatggcagagcacttggtggtcacatgaagtctcacttggtctcatctcagtcttcagctcggaagaaactaggtgactcggtctattcttcttcttcctcttcctccgatggtaaagcgctcgcctacgggttacgagagaacccgaggaagagtttccgggtctttaatccggatcctgagtcatccacaatttacaacagtgagacagagaccgaacctgaatccggagacccggttaagaaacgggtcagaggagatgtttcaaagaagaagaagaagaaggcaaagagtaagagagtgtttgagaactcgaagaagcaaaagacaattcacgagtcaccagaaccagcgagttctgtctctgatggttctcctgaacaagatttagctatgtgcttgatgatgctgtcaagagattcaagggagctcgagattaaactgaaaaaaccggaggaagagaggaagccggaaaaaagacatttccctgagctccgtcgctgtatgatagatctgaatcttcctccgccgcaagaagctgaagctgtcaccgtcgtttcagccatataa

SEQ ID NO: 2300 - protein, 204 aa, Arabidopsis thaliana
  G357
MQNKHKCKLCSKSFCNGRALGGHMKSHLVSSQSSARKKLGDSVYSSSSSSSDGKALAYGLRENPRKSFRVFNPDPESSTIYNSETETEPESGDPVKKRVRGDVSKKKKKKAKSKRVFENSKKQKTIHESPEPASSVSDGSPEQDLAMCLMMLSRDSRELEIKLKKPEEERKPEKRHFPELRRCMIDLNLPPPQEAEAVTVVSAI

SEQ ID NO: 2301 - DNA, 855 bp, Arabidopsis thaliana
  G358
atgggtcaagatgaggttgggagtgatcagacgcaaatcataaaagggaaacgtacgaagcgacaaagatcgtcttcgacgtttgtggtgacggcggcgacaacagtgacttcaacaagttcatcggccggtggaagtggaggagaaagagctgtttcagatgaatacaactcggcggtttcgtctccggtgactactgattgtacgcaagaagaagaagacatggcgatttgtctcatcatgttagctcgtgggacagttcttccatcgccggatctcaagaactcgagaaaaattcatcagaagatttcgtcggagaattctagtttctatgtgtacgagtgtaaaacgtgtaaccggacgttttcgtcgttccaagcacttggtggacacagagcgagccacaagaagccgaggacgtcgactgaggaaaagactagactacccctgacgcaacccaagtctagtgcatcagaagaagggcaaaacagtcatttcaaagtttccggctcagccctagcttcacaggcaagtaacatcatcaacaaggcaaacaaagtacacgagtgttccatctgcggttctgagttcacttccgggcaagctctcggtggtcacatgaggcggcacaggacagccgtaaccacgattagccccgttgcagccaccgcagaagtaagcagaaacagtacagaggaagagattgagatcaatataggccgttcgatggaacagcagaggaaatatctaccgttggatcttaatctaccagcaccagaagatgatctaagagagtcaaagtttcaagggatagtattctcagcaacaccagcgttaatagattgtcattactag

SEQ ID NO: 2302 - protein, 284 aa, Arabidopsis thaliana
  G358
MGQDEVGSDQTQIIKGKRTKRQRSSSTFVVTAATTVTSTSSSAGGSGGERAVSDEYNSAVSSPVTTDCTQEEEDMAICLIMLARGTVLPSPDLKNSRKIHQKISSENSSFYVYECKTCNRTFSSFQALGGHRASHKKPRTSTEEKTRLPLTQPKSSASEEGQNSHFKVSGSALASQASNIINKANKVHECSICGSEFTSGQALGGHMRRHRTAVTTISPVAATAEVSRNSTEEEIEINIGRSMEQQRKYLPLDLNLPAPEDDLRESKFQGIVFSATPALIDCHY

SEQ ID NO: 2303 - DNA, 543 bp, Arabidopsis thaliana
  G360
atgtggaaccctaacaaaattgaagaattggaggatgatgatgaatcttgggaagtcaaagcctttgagcaagacactaaaggcaacatctctggtaccacttggcctccaagatcttacacttgcaatttctgccgccgtgagttccgttctgctcaagccttaggcggtcacatgaatgtccaccgccgtgaccgcgcctcatctagggctcatcaaggttccaccgttgcggctgcggctagaagcggccacggggggatgttactcaattcttgtgctccgccgttgcctacaacgacacttataatacaatccacggcgagtaacattgaaggtttgtcccatttctaccaactgcaaaaccctagtggcatttttggtaattctggtgacatggtgaatctttatgtagaagttcctcctcggcttattgaatattcgacaggagatgatgagagcattggctcgatgaaagaagcgacaggaacatcagtggatgagcttgatcttgaacttcggctagggcaccatccaccgtga

SEQ ID NO: 2304 - protein, 180 aa, Arabidopsis thaliana
  G360
MWNPNKIEELEDDDESWEVKAFEQDTKGNISGTTWPPRSYTCNFCRREFRSAQALGGHMNVHRRDRASSRAHQGSTVAAAARSGHGGMLLNSCAPPLPTTTLIIQSTASNIEGLSHFYQLQNPSGIFGNSGDMVNLYVEVPPRLIEYSTGDDESIGSMKEATGTSVDELDLELRLGHHPP

SEQ ID NO: 2305 - DNA, 780 bp, Arabidopsis thaliana
  G363
atgagaccaatattagacctcgaaattgaagcttcatcgggcagtagtagcagccaagtggcctcaaacttgtctccggttggggaagattacaaaccaatctcgctgaatcttagcctcagtttcaacaacaacaacaacaataatctggatcttgaatcatcgtctttgacgctgccactttcgagcacgagtgagagtagtaacccggagcagcagcagcaacaacaaccatctgtatcaaagagagtcttctcttgtaactactgccaaaggaagttctatagctctcaagcgctaggtggtcaccaaaacgctcacaaacgtgagagaacactcgccaaacgcgctatgctatgggtcttgctggggtcttccccggtagaggatcaagtagcaattatgcggctgctgccacagcagccgctctcgtgtttgccgcttcacggaagcggaaacgggaacatgacatcgttcaggactttgggaatccgggcacattcctcggcgcacgacgtcagcatgacaaggcagacaccagaaacacttattagaaacattgccaggttcaaccaggggtatttcggtaattgtatacctttttacgtggaggacgacgaggccgagatgctctggccggggagtttccggcaagctacgaatgcggttgcggttgaagcgggtaatgataatttaggtgaaagaaaaatggatttcttggacgtcaagcaagcgatggatatggaaagttctcttccagatctaaccttgaagctttga

SEQ ID NO: 2306 - protein, 259 aa, Arabidopsis thaliana
  G363
MRPILDLEIEASSGSSSSQVASNLSPVGEDYKPISLNLSLSFNNNNNNNLDLESSSLTLPLSSTSESSNPEQQQQQQPSVSKRVFSCNYCQRKFYSSQALGGHQNAHKRERTLAKRAMLWVLLGSSPVEDQVAIMRLLPQQPLSCLPLHGSGNGNMTSFRTLGIRAHSSAHDVSMTRQTPETLIRNIARFNQGYFGNCIPFYVEDDEAEMLWPGSFRQATNAVAVEAGNDNLGERKMDFLDVKQAMDMESSLPDLTLKL

SEQ ID NO: 2307 - DNA, 728 bp, Arabidopsis thaliana
  G364
aagcttgatatcgcctctctctaatctctctttctctctctatctctaagaatatataaaggtatggactaccagccaaacacatccctacgtctaagcctaccaagttacaagaaccaccaactaaacctagaacttgttctcgagccttcttccatgtcttcttcttcatcttcttccacgaactcatcatcatgtttggagcagcctagggtattctcatgtaactattgtcaaagaaagttttacagctctcaagctcttggtggtcatcaaaacgctcataagcttgagagaaccttagccaagaagagtcgagaactctttagatcctcaaacactgttgattctgatcagccttacccgttctccggtcgctttgagctttacggccgtggctaccaaggatttctcgaaagtggcggctcgagggacttctccgcccgccgtgtgccggagagtggtcttgatcaggatcaggagaagagtcaccttgacttatccttaaggctctaaaagaatcttatattttgttagtctatatattatcatatcaattgttaatcttaaaattgattgttttacttattagtcatttcctattatctgaaagttttctttgtaagttgtaactatggtcctaaattcaaatccaaatttgattttggaagatggtacctaatgcagtagttaaataagttaaaaaaatgaaggatctataattctct

SEQ ID NO: 2308 - protein, 150 aa, Arabidopsis thaliana
  G364
MDYQPNTSLRLSLPSYKNHQLNLELVLEPSSMSSSSSSSTNSSSCLEQPRVFSCNYCQRKFYSSQALGGHQNAHKLERTLAKKSRELFRSSNTVDSDQPYPFSGRFELYGRGYQGFLESGGSRDFSARRVPESGLDQDQEKSHLDLSLRL

SEQ ID NO: 2309 - DNA, 925 bp, Arabidopsis thaliana
  G365
caattcttttactttcattctctttatatattctctctacgctataatatatattacacagaatatacatggaaccgtccatcaaaggagatcaagaaatgttaaaaatcaagaaacaaggtcatcaagatcttgagttggggttgacccttttgtcacgtggaaccgcgacctcatcagagctcaatctcatcgattctttcaaaaccagctcatcatcgacttctcatcatcagcaccagcaagaacaattggcagatccgagagtgttctcgtgtaattattgtcaaagaaagttctatagttcacaagcgctaggcggtcaccaaaacgctcataaacgtgagcgcaccttagccaaacgtggacagtattacaagatgactctctcctccttgccttcttcagcgtttgcgtttggccacggttcagtcagcagattcgcaagcatggcatcgttaccattacatggctcggtgaataacaggtcaacgttagggattcaagctcattcaacgatccataagcccagcttcttaggaagacaaacgacgagtttaagtcatgttttcaaacagagcattcaccagaaaccgaccataggaaagatgttgccggagaaatttcaccttgaagtcgccggaaataataacagtaacatggttgctgctaagttggagagaattggacatttcaagagcaaccaagaagatcataatcagtttaagaaaattgacttgactcttaagctatgagctctgccatcttctttttagtcttcattataactttttttattctcatctttgtttgatataatgattgacggcagggtgtgttagagtttcactaatgatcaagttgtactttttatatatttcattgataccttgttgatgtaattcaatattttaggtctgttttt

SEQ ID NO: 2310 - protein, 228 aa, Arabidopsis thaliana
  G365
MEPSIKGDQEMLKIKKQGHQDLELGLTLLSRGTATSSELNLIDSFKTSSSSTSHHQHQQEQLADPRVFSCNYCQRKFYSSQALGGHQNAHKRERTLAKRGQYYKMTLSSLPSSAFAFGHGSVSRFASMASLPLHGSVNNRSTLGIQAHSTIHKPSFLGRQTTSLSHVFKQSIHQKPTIGKMLPEKFHLEVAGNNNSNMVAAKLERIGHFKSNQEDHNQFKKIDLTLKL

SEQ ID NO: 2311 - DNA, 708 bp, Arabidopsis thaliana
  G367
atggacgcttcaatagtttcctcatccactgcttttccatatcaagattctctaaaccagagcatcgaagacgaagaaagagacgttcataattctagtcacgaactcaatctcatcgactgcatagacgacacaacgagtatcgttaacgaatctacaacatccacagaacaaaagcttttctcatgcaactattgtcaaagaactttctatagctcacaagcacttggtggtcaccaaaacgcacacaagagagagagaacgttggcgaagagaggacaacgtatggcagcgtcagcctcagcttttggacatccttacggtttctctccacttcctttccacggacagtacaacaaccataggtctttagggatccaagcgcattcgataagccacaagctaagttcttataacgggtttggtggtcactatggtcagatcaactggtcaagacttccatttgatcaacaaccagccataggtaaatttccctcaatggataattttcatcatcatcatcatcagatgatgatgatggctccttcagtaaattcacggtccaataacatcgatagcccaagcaacacaggacgggttctagaagggtcaccgactcttgaacaatggcacggagacaaaggattgttgttaagtacaagtcatcatgaagagcagcagaaacttgacttgtccctcaagctttga

SEQ ID NO: 2312 - protein, 235 aa, Arabidopsis thaliana
  G367
MDASIVSSSTAFPYQDSLNQSIEDEERDVHNSSHELNLIDCIDDTTSIVNESTTSTEQKLFSCNYCQRTFYSSQALGGHQNAHKRERTLAKRGQRMAASASAFGHPYGFSPLPFHGQYNNHRSLGIQAHSISHKLSSYNGFGGHYGQINWSRLPFDQQPAIGKFPSMDNFHHHHHQMMMMAPSVNSRSNNIDSPSNTGRVLEGSPTLEQWHGDKGLLLSTSHHEEQQKLDLSLKL

SEQ ID NO: 2313 - DNA, 1854 bp, Arabidopsis thaliana
  G373
atggcgattgaaactcagcttccttgcgacggtgacggtgtgtgtatgcggtgtcaggtgaatcctccgtcagaagagactctcacttgtggcacgtgcgtcactccatggcacgtgccgtgtctcctccccgaatcactcgcttcttccactggagagtgggagtgtcccgattgctccggcgttgtcgttccctccgccgctccgggtaccggaaacgctcgacctgaatcttccggttcagttctcgttgctgcgatccgtgcgattcaggctgatgagactttaaccgaagctgagaaagccaaaaaaaggcagaaactgatgagtgggggtggtgacgatggtgtcgatgaagaagagaagaagaagttagaaatcttttgttctatttgcattcaattgccagaaagacctatcacgacaccgtgtgggcacaatttctgtttgaaatgtttcgagaaatgggcagtaggtcaagggaagctaacttgtatgatatgccgaagcaaaattccgagacatgtggcaaaaaatcctcgcatcaacttagctctagtttctgctattcgtttagcaaatgttaccaaatgttctgttgaggcaactgcagccaaggttcatcatattatccgcaaccaagaccgtcctgagaaagcatttactaccgagcgggcagtaaaaactgggaaagctaatgctgctagcggtaagttttttgtgacaatacctcgtgatcattttggtcccataccagctgagaatgatgtcactagaaagcaaggtgttttggttggagaatcttgggaggacaggcaagagtgtaggcagtggggagctcatttcccgcatattgctggcattgccgggcaatcagcggttggagctcagtctgtggccctctctggaggttatgacgatgatgaggatcatggtgaatggtttctctacacaggaagtggtggaagggatctcagtggaaacaaaagaattaacaagaaacagtcgtctgaccaggcgtttaaaaacatgaatgaatctctaagacttagttgcaaaatgggctatcctgtccgagttgtcaggtcttggaaggagaagcgttctgcatatgcccctgctgaaggtgtgagatatgatggggtctatcgaattgagaagtgctggagtaatgttggagtacagggttcttttaaggtctgtcgttacctgtttgttagatgtgacaatgagccagctccatggaccagtgatgagcatggcgatcgtccaagaccgttgcctaatgttccggagcttgagactgctgctgacctgtttgtgagaaaggagagtccatcatgggatttcgatgaagctgagggtcgttggaaatggatgaagtctcctcctgttagcagaatggctttggatcctgaggagaggaagaagaataagagagcaaaaaatactatgaaggccagacttctgaaagaatttagttgccaaatctgtcgggaagtgctgagtcttccagtgacgacgccttgtgcacacaacttctgcaaagcatgcttagaagcgaagtttgctgggataactcaactgagagagagaagcaatggcggacgtaaactacgtgcaaagaagaacatcatgacctgcccttgctgcacgacggatctctccgagtttctccaaaacccgcaggtgaacagagagatgatggagataatagagaattttaagaagagtgaggaagaggctgatgcatccatttctgaagaagaagaagaagaatccgaacctccaactaagaagattaagatggataacaactctgttggtggtagtggtacaagtctctcagcttaa

SEQ ID NO: 2314 - protein, 617 aa, Arabidopsis thaliana
  G373
MAIETQLPCDGDGVCMRCQVNPPSEETLTCGTCVTPWHVPCLLPESLASSTGEWECPDCSGVVVPSAAPGTGNARPESSGSVLVAAIRAIQADETLTEAEKAKKRQKLMSGGGDDGVDEEEKKKLEIFCSICIQLPERPITTPCGHNFCLKCFEKWAVGQGKLTCMICRSKIPRHVAKNPRINLALVSAIRLANVTKCSVEATAAKVHHIIRNQDRPEKAFTTERAVKTGKANAASGKFFVTIPRDHFGPIPAENDVTRKQGVLVGESWEDRQECRQWGAHFPHIAGIAGQSAVGAQSVALSGGYDDDEDHGEWFLYTGSGGRDLSGNKRINKKQSSDQAFKNMNESLRLSCKMGYPVRVVRSWKEKRSAYAPAEGVRYDGVYRIEKCWSNVGVQGSFKVCRYLFVRCDNEPAPWTSDEHGDRPRPLPNVPELETAADLFVRKESPSWDFDEAEGRWKWMKSPPVSRMALDPEERKKNKRAKNTMKARLLKEFSCQICREVLSLPVTTPCAHNFCKACLEAKFAGITQLRERSNGGRKLRAKKNIMTCPCCTTDLSEFLQNPQVNREMMEIIENFKKSEEEADASISEEEEEESEPPTKKIKMDNNSVGGSGTSLSA

SEQ ID NO: 2315 - DNA, 1805 bp, Arabidopsis thaliana
  G374
attccctctcttcgatttttaattccttgctcctctgctcgtttctctaccggcgacgtaacctctctgtctctgttctgttccttgcctgctcgaggtgtgcatcttcttggaatcagctgactttgcggtcaatcggatttcttgggattgtttggagaaactttggaggtgatggacaacaaaaatgatcaggatattgatgttagatcagtggttgaagctgtttccgccgatctttcctttggtgctcccctctatgtggttgagagcatgtgcatgcgctgccaagaaaatggaacaaccagatttctattgaccttaattcctcacttcagaaaggtcttaatatctgcatttgaatgtccgcattgcggggaaaggaataatgaagttcagttcgcaggcgagattcaaccccgtggatgctgttacaatctagaggttctagctggtgatgtgaagatatttgaccggcaagttgtgaaatctgaatcagccactattaagattcctgaactggattttgagattccaccagaggcccaacgtggaagtttgtctactgtggaagggatattagcacgggctgctgatgaactgagtgcccttcaagaagaacgcaagaaagttgatcctaaaactgctgaagcaatagaccaattcttgtccaaactgagagcttgtgctaaagcagagacatccttcaccttcattttggatgatcctgctggaaacagtttcattgagaacccacatgctccatcaccagatccctctctaaccatcaaattctatgagcgaacaccagagcaacaagcaacacttggatatgttgctaacccatctcaggctggacaatcagaaggaagccttggcgcaccttctactaaaacagcttatgtacctaatggaacaatcggagcaactgctggtcatcgcgcgattgctcagagtaatagcactgatatttccgacaacttgttcagatactctgcgcctgaagaggtgatgactttcccttcaacttgcggagcatgtacggagccgtgtgagacacggatgttcgtgactaaaatcccgtactttcaggaagttattgtcatggcatctacatgtgacagttgtggctatcgtaattctgagttgaagcctggtggtgcaattcctgaaaagggaaagaagattactctctctgtgaggaacattacagaccttagccgagatgttatcaagtcggacactgcaggagtgataatcccagaacttgatctggagctagctggtggtacacttggtggaatggtaacaacagttgaagggttggttacacagatcagagaaagcctagcgagagttcacggattcacttttggtgatagtatggaagagagtaagttgaacaaatggagagaatttggagccaggctcactaagctcctaagctttgaacagccgtggacattgattcttgatgatgaattagcaaattcctttattgcaccagtaacagatgatatcaaagatgaccatcagctcacatttgaagagtacgagaggtcatgggatcaaaacgaggagttgggtctcaacgacatagatacttcttcagctgatgctgcttatgaatccacagagacgactaaattaccttaagattagttggtcttacatgatttaattttagatggtgatgatcagactgatggatccatatgttgttgtattgtaacaattaaagaatcaaagaacaaattcctctttttaatctattaaaaaaaaaacttttgagccaaaaaaaaaac

SEQ ID NO: 2316 - protein, 493 aa, Arabidopsis thaliana
  G374
MDNKNDQDIDVRSVVEAVSADLSFGAPLYVVESMCMRCQENGTTRFLLTLIPHFRKVLISAFECPHCGERNNEVQFAGEIQPRGCCYNLEVLAGDVKIFDRQVVKSESATIKIPELDFEIPPEAQRGSLSTVEGILARAADELSALQEERKKVDPKTAEAIDQFLSKLRACAKAETSFTFILDDPAGNSFIENPHAPSPDPSLTIKFYERTPEQQATLGYVANPSQAGQSEGSLGAPSTKTAYVPNGTIGATAGHRAIAQSNSTDISDNLFRYSAPEEVMTFPSTCGACTEPCETRMFVTKIPYFQEVIVMASTCDSCGYRNSELKPGGAIPEKGKKITLSVRNITDLSRDVIKSDTAGVIIPELDLELAGGTLGGMVTTVEGLVTQIRESLARVHGFTFGDSMEESKLNKWREFGARLTKLLSFEQPWTLILDDELANSFIAPVTDDIKDDHQLTFEEYERSWDQNEELGLNDIDTSSADAAYESTETTKLP

SEQ ID NO: 2317 - DNA, 1290 bp, Arabidopsis thaliana
  G375
tcgacaaaaactctcactctccctcaaactaaacaaacatacagaacacaaaatgggtctcacttctcttcaagtttgcatggattctgattggctccaggaatccgagtcatcaggaggaagcatgttagactcttcaacgaattctccgtcagcagccgacatactagcagcttgcagcactagaccacaagcctcggccgtggctgtagccgctgcagctctgatggacggtggaaggaggctgcgtccacctcacgaccatcctcaaaagtgtcctcgttgcgagtcaacacatactaagttctgttactacaataactacagcctctctcagcctcgttacttctgcaagacttgtcgccgttactggacaaaaggcggaactctaaggaatattccggttggtggtggatgccgtaaaaacaagaaaccatcttcctctaattcctcctcctccacttcttccggcaaaaaaccatccaacatcgttaccgccaatacctctgatcttatggctttagcacattctcatcaaaattaccaacattctcctctagggttttcacattttggtgggatgatggggtcttactcaactccggagcatggtaacgttggtttcttggagagcaagtatggcggtttgctttcgcagagccctagacctattgatttcttggacagtaagtttgatctcatgggagtgaacaatgacaacctggtcatggttaatcatggaagtaacggagatcatcatcatcatcataatcatcacatgggtctgaatcacggtgtaggtcttaacaacaacaacaacaatggtggatttaatgggatttctacgggaggcaatggaaatggtggtggtctcatggatatatcgacatgccaaagacttatgctatctaattatgatcatcaccattacaatcatcaagaagatcatcaaagggtagcaacaataatggatgtgaagccaaatccgaagttgttatcgcttgattggcagcaagatcaatgctactccaatggtggtggtagcggaggcgcaggaaaatccgacggtggtggatacggcaatggtggttatatcaacggtttaggttcgtcgtggaatggtttgatgaatggctatggaacgtccactaaaacaaactccttggtttgataagttaatcagaacttcttttttcttgtcgtcatcaactagtagtagtagtaatagtagttggagactagagaagcacttcaaattatttatgggtttgtttgctaagccagttttac

SEQ ID NO: 2318 - protein, 372 aa, Arabidopsis thaliana
  G375
MGLTSLQVCMDSDWLQESESSGGSMLDSSTNSPSAADILAACSTRPQASAVAVAAAALMDGGRRLRPPHDHPQKCPRCESTHTKFCYYNNYSLSQPRYFCKTCRRYWTKGGTLRNIPVGGGCRKNKKPSSSNSSSSTSSGKKPSNIVTANTSDLMALAHSHQNYQHSPLGFSHFGGMMGSYSTPEHGNVGFLESKYGGLLSQSPRPIDFLDSKFDLMGVNNDNLVMVNHGSNGDHHHHHNHHMGLNHGVGLNNNNNNGGFNGISTGGNGNGGGLMDISTCQRLMLSNYDHHHYNHQEDHQRVATIMDVKPNPKLLSLDWQQDQCYSNGGGSGGAGKSDGGGYGNGGYINGLGSSWNGLMNGYGTSTKTNSLV

SEQ ID NO: 2319 - DNA, 396 bp, Arabidopsis thaliana
  G377
atgggtctctcgcattttccaacagcgtcagaaggagtactaccacttctggtgatgaacacggttgtttcaatcactctgttgaagaacatggtgaggtctgtttttcaaattgttgcatccgagactgaatcttccatggagatagacgacgagcctgaagatgattttgttactagaagaatctcgataacacagttcaagtctctatgtgagaacatagaagaggaagaagaagagaaaggtgtggagtgttgtgtgtgcctttgtgggtttaaagaggaagaggaagtgagtgagttggtttcttgcaagcatttcttccacagagcttgtctagacaactggtttggtaataaccacaccacatgccctctttgcaggtccattctctag

SEQ ID NO: 2320 - protein, 131 aa, Arabidopsis thaliana
  G377
MGLSHFPTASEGVLPLLVMNTVVSITLLKNMVRSVFQIVASETESSMEIDDEPEDDFVTRRISITQFKSLCENIEEEEEEKGVECCVCLCGFKEEEEVSELVSCKHFFHRACLDNWFGNNHTTCPLCRSIL

SEQ ID NO: 2321 - DNA, 726 bp, Arabidopsis thaliana
  G378
atggcctcgtcatcatcatcatcttatagattccaatctgggtcttaccctctttcgtcaagtccttctcttgggaatttcgtcgaacgcattaaagacgcttgtcatttccttgtctctgctgttttgggtaccattatctccgcgatcttgaccttcttcttcgcactagtgggcacattgctaggggcacttacaggagctttgataggtcaagaaactgagagtggtttcattagaggagcagcaattggagccatttcgggagctgttttctctatcgaggtctttgaatcatctctggatctctggaaatccgatgagtcgggtttcggatgttttctctacttgattgatgtcattgttagtcttctaagcgggagacttgtacgagagcgcattggtcctgcaatgctaagtgcagtgcaaagtcaaatgggagctgtggatacagcttttgatgatcacacaagcctttttgatacaggaggctcaaaaggattgacaggagaccttgttgagaaaatcccaaagatgacaatcactggcaacaataacactgatgcttctgagaacacagactcatgttctgtttgtcttcaggatttccagctcggtgaaacagttagaagcttgcctcattgtcatcacatgtttcacttaccttgcatagacaattggctccttagacacggttcttgcccgatgtgtagacgtgatatttaa

SEQ ID NO: 2322 - protein, 241 aa, Arabidopsis thaliana
  G378
MASSSSSSYRFQSGSYPLSSSPSLGNFVERIKDACHFLVSAVLGTIISAILTFFFALVGTLLGALTGALIGQETESGFIRGAAIGAISGAVFSIEVFESSLDLWKSDESGFGCFLYLIDVIVSLLSGRLVRERIGPAMLSAVQSQMGAVDTAFDDHTSLFDTGGSKGLTGDLVEKIPKMTITGNNNTDASENTDSCSVCLQDFQLGETVRSLPHCHHMFHLPCIDNWLLRHGSCPMCRRDI

SEQ ID NO: 2323 - DNA, 2217 bp, Arabidopsis thaliana
  G385
tagggtttgctttcagtttccggagtataagaaaagatgttcgagccaaatatgctgcttgcggctatgaacaacgcagacagcaataaccacaactacaaccacgaagacaacaataatgaaggatttcttcgggacgatgaattcgacagtccgaatactaaatcgggaagtgagaatcaagaaggaggatcaggaaacgaccaagatcctcttcatcctaacaagaagaaacgatatcatcgacacacccaacttcagatccaggagatggaagcgttcttcaaagagtgtcctcacccagatgacaagcaaaggaaacagctaagccgtgaattgaatttggaacctcttcaggtcaaattctggttccaaaacaaacgtacccaaatgaagaatcatcacgagcggcatgagaactcacatcttcgggcggagaacgaaaagcttcgaaacgacaacctaagatatcgagaggctcttgcaaatgcttcgtgtcctaattgtggtggtccaacagctatcggagaaatgtcattcgacgaacaccaactccgtctcgaaaatgctcgattaagggaagagatcgaccgtatatccgcaatcgcagctaaatacgtaggcaagccagtctcaaactatccacttatgtctcctcctcctcttcctccacgtccactagaactcgccatgggaaatattggaggagaagcttatggaaacaatccaaacgatctccttaagtccatcactgcaccaacagaatctgacaaacctgtcatcatcgacttatccgtggctgcaatggaagagctcatgaggatggttcaagtagacgagcctctgtggaagagtttggctttagacgaagaagaatatgcaaggacctttcctagagggatcggacctagaccggctggatatagatcagaagcttcgcgagaaagcgcggttgtgatcatgaatcatgttaacatcgttgagattctcatggatgtgaatcaatggtcgacgattttcgcggggatggtttctagagcaatgacattagcggttttatcgacaggagttgcaggaaactataatggagctcttcaagtgatgagcgcagagtttcaagttccatctccattagtcccaacacgtgaaacctatttcgcacgttactgtaaacaacaaggagatggttcgtgggcggttgtcgatatttcgttggatagtctccaaccaaatcccccggctagatgcaggcggcgagcttcaggatgtttgattcaagaattgccaaatggatattctaaggtgacttgggtggagcatgtggaagttgatgacagaggagttcataacttatacaaacacatggttagtactggtcatgccttcggtgctaaacgctgggtagccattcttgaccgccaatgcgagcggttagctagtgtcatggctacaaacatttcctctggagaagttggcgtgataaccaaccaagaagggaggaggagtatgctgaaattggcagagcggatggttataagcttttgtgcaggagtgagtgcttcaaccgctcacacgtggactacattgtccggtacaggagctgaagatgttagagtgatgactaggaagagtgtggatgatccaggaaggtctcctggtattgttcttagtgcagccacttctttttggatccctgttcctccaaagcgagtctttgacttcctcagagacgagaattcaagaaatgagtgggatattctgtctaatggaggagttgtgcaagaaatggcacatattgctaacgggagggataccggaaactgtgtttctcttcttcgggtaaatagtgcaaactctagccagagcaatatgctgatcctacaagagagctgcattgatcctacagcttcctttgtgatctatgctccagtcgatattgtagctatgaacatagtgcttaatggaggtgatccagactatgtggctctgcttccatcaggttttgctattcttcctgatggtaatgccaatagtggagcccctggaggagatggagggtcgctcttgactgttgcttttcagattctggttgactcagttcctacggctaagctgtctcttggctctgttgcaactgtcaataatctaatagcttgcactgttgagagaatcaaagcttcaatgtcttgtgagactgcttgaaaaccatccattagc

SEQ ID NO: 2324 - protein, 721 aa, Arabidopsis thaliana
  G385
MFEPNMLLAAMNNADSNNHNYNHEDNNNEGFLRDDEFDSPNTKSGSENQEGGSGNDQDPLHPNKKKRYHRHTQLQIQEMEAFFKECPHPDDKQRKQLSRELNLEPLQVKFWFQNKRTQMKNHHERHENSHLRAENEKLRNDNLRYREALANASCPNCGGPTAIGEMSFDEHQLRLENARLREEIDRISAIAAKYVGKPVSNYPLMSPPPLPPRPLELAMGNIGGEAYGNNPNDLLKSITAPTESDKPVIIDLSVAAMEELMRMVQVDEPLWKSLALDEEEYARTFPRGIGPRPAGYRSEASRESAVVIMNHVNIVEILMDVNQWSTIFAGMVSRAMTLAVLSTGVAGNYNGALQVMSAEFQVPSPLVPTRETYFARYCKQQGDGSWAVVDISLDSLQPNPPARCRRRASGCLIQELPNGYSKVTWVEHVEVDDRGVHNLYKHMVSTGHAFGAKRWVAILDRQCERLASVMATNISSGEVGVITNQEGRRSMLKLAERMVISFCAGVSASTAHTWTTLSGTGAEDVRVMTRKSVDDPGRSPGIVLSAATSFWIPVPPKRVFDFLRDENSRNEWDILSNGGVVQEMAHIANGRDTGNCVSLLRVNSANSSQSNMLILQESCIDPTASFVIYAPVDIVAMNIVLNGGDPDYVALLPSGFAILPDGNANSGAPGGDGGSLLTVAFQILVDSVPTAKLSLGSVATVNNLIACTVERIKASMSCETA

SEQ ID NO: 2325 - DNA, 1249 bp, Arabidopsis thaliana
  G394
gaaattcttaacaaacaattttcttcataatattaattctcaagatcttaaagattatattaatacgaagagaaaattcaaatgggtcttgatgattcatgcaacacaggtcttgttcttggtttaggcctctcaccaacgcctaataattacaatcatgccatcaagaaatcttcctccactgtggaccatcgtttcatcaggctcgatccgtcgttgactctaagcctatccggtgagagctacaagatcaagactggtgccggcgccggcgaccaaatttgccggcagacctcgtcccacagcggcatctcatctttctcgagcggaagggtaaagagagaaagagaaatctccggcggcgatggagaagaagaggcggaggagacgacggagagagtggtgtgttcgagagtgagtgatgatcatgacgatgaagaaggtgttagtgctcgtaaaaagcttagactcactaaacaacaatctgctcttctcgaagataacttcaaacttcatagcacccttaatcccaagcaaaaacaagctcttgcgagacagctgaatctaaggcctagacaagttgaagtgtggttccaaaacaggagagctagaacaaaactaaagcaaacagaagtggattgtgagtttttgaagaaatgttgcgagactttaacggatgagaatagaaggcttcaaaaagagcttcaagaccttaaggctttaaaattgtctcaaccgttttacatgcacatgccggcggcgactttgactatgtgcccttcttgtgagagactcggcggtggtggtgtcggaggagatacgacggcggttgatgaagaaacggcgaaaggagctttctccatcgtcacaaagcctcgtttctataaccctttcactaatccttctgcagcatgttagttacttattagttatttaattctttttgttggttttttttttgtttcttaaatcaaattaggaattagttagaagataaatcccagggaaaaaatattacgttgaaattggggggaaatggggtatagtctttatagataagactcttcaacgattccactttatttttcggtgggattgttggttgatgaagaaaaaaaaatagtttgtaattacaggtttaaatatgtagagaaaaaatgacgaatatgtattatcttgtttttttttccttcgaatatgtattacggtaatataaatttgcttgtaaaaataataaatatattatttg

SEQ ID NO: 2326 - protein, 278 aa, Arabidopsis thaliana
  G394
MGLDDSCNTGLVLGLGLSPTPNNYNHAIKKSSSTVDHRFIRLDPSLTLSLSGESYKIKTGAGAGDQICRQTSSHSGISSFSSGRVKREREISGGDGEEEAEETTERVVCSRVSDDHDDEEGVSARKKLRLTKQQSALLEDNFKLHSTLNPKQKQALARQLNLRPRQVEVWFQNRRARTKLKQTEVDCEFLKKCCETLTDENRRLQKELQDLKALKLSQPFYMHMPAATLTMCPSCERLGGGGVGGDTTAVDEETAKGAFSIVTKPRFYNPFTNPSAAC

SEQ ID NO: 2327 - DNA, 957 bp, Arabidopsis thaliana
  G396
atgggggaaagagatgatgggttgggtttgagtctaagcttgggaaatagtcaacaaaaagaaccatctctgaggttgaatcttatgccgttgacaacttcttcttcttcttcttcgtttcaacacatgcacaatcagaataacaatagccatccccagaagattcataacatctcttggactcatctgtttcaatcttctgggattaaacgtacaactgcagagagaaactccgacgccgggtcatttctaagaggtttcaacgtgaacagagctcagtcttcggtggcggtagtggacttggaagaagaagccgccgtcgtctcgtctccaaacagcgccgtttcgagtctgagtggaaataaaagggatcttgcggtggcgagaggaggagatgaaaacgaggcggagagagcttcttgctcacgcggagggggaagcggtggtagcgacgatgaagacggcggaaacggcgacggatcaaggaagaaactacggttatcgaaggatcaagctcttgttctcgaggagacttttaaagaacatagcactcttaatccgaagcaaaagctggctctagcaaaacagttgaatctaagggcaagacaagttgaagtgtggtttcagaaccgtagggcaaggacgaagctgaaacaaacggaggttgattgtgagtatttaaagagatgttgcgataatctgaccgaggagaatcgacggctgcagaaagaagtgtcggagctgagggcgttgaagttgtctccacatctctacatgcacatgactcctcctactactctcaccatgtgcccttcttgcgaacgtgtctcctcctctgccgccactgtgaccgctgctccttccactactactactcctacggtggtggggcggccaagtccacagcgattaactccttggactgctatttctctccagcaaaaatcaggtcgctag

SEQ ID NO: 2328 - protein, 318 aa, Arabidopsis thaliana
  G396
MGERDDGLGLSLSLGNSQQKEPSLRLNLMPLTTSSSSSSFQHMHNQNNNSHPQKIHNISWTHLFQSSGIKRTTAERNSDAGSFLRGFNVNRAQSSVAVVDLEEEAAVVSSPNSAVSSLSGNKRDLAVARGGDENEAERASCSRGGGSGGSDDEDGGNGDGSRKKLRLSKDQALVLEETFKEHSTLNPKQKLALAKQLNLRARQVEVWFQNRRARTKLKQTEVDCEYLKRCCDNLTEENRRLQKEVSELRALKLSPHLYMHMTPPTTLTMCPSCERVSSSAATVTAAPSTTTTPTVVGRPSPQRLTPWTAISLQQKSGR

SEQ ID NO: 2329 - DNA, 2545 bp, Arabidopsis thaliana
  G418
acatatgttttaaattctttgtctgaatcttacaggatccgagagagagagctctggaacgatattaacatatatcatgaagaaaaagattgaagtattgatatgggaataactaaaacttctcctaatactacaattctcttgaagacttttcacaataattctatgtcccaagattatcatcatcatcatcatcataatcaacaccaaggaggtatcttcaacttctctaatggattcgaccgatcagattctcccaatttaacaactcagcagaagcaagagcatcaaagggtagagatggacgaggaatcttcagtcgccggaggtaggattccggtctacgaatcagccggtatgttatccgaaatgtttaatttccccggaagcagcggtggaggaagagatctcgacctcggccaatctttccggtcaaataggcagttgcttgaggagcaacatcagaatattccggctatgaatgctacggattcagccaccgccaccgcagccgccatgcagttattcttgatgaatccaccgccaccgcaacaaccaccgtctccgtcatccacaacttccccaaggagccaccacaattcttcaactcttcacatgttacttccaagtccatccaccaacacaactcaccatcagaactacactaatcatatgtctatgcatcagcttccacatcagcatcaccaacagatatcgacgtggcagtcttctcccgatcatcatcatcatcatcacaacagccaaacggagattgggaccgtccacgtggaaaacagcggaggacacggaggacaaggcttgtccttatctctctcatcgtctttagaggctgcagcaaaagcggaagagtatagaaacatttactacggagccaattcttctaacgcatcacctcatcatcaatacaatcaattcaagactcttcttgctaattcttctcaacatcaccatcaagtattaaaccaattccgatcatctccggctgcttcttcctcttccatggcagcggtcaatatcttaagaaactcgaggtacacaacggccgcgcaagagttgttggaagagttttgtagtgttggaagaggatttttgaagaagaacaaacttgggaacagctcaaaccctaatacttgcggtggtgatggtggtggcagctctccttcgtcggccggagcaaacaaggagcatcctcctttatcggcgtctgatcggattgagcatcaaagaaggaaagtgaaactactcaccatgcttgaagaggtggaccgacggtacaaccattactgcgagcaaatgcagatggttgtgaactctttcgacatagtaatgggccacggtgcggcattaccgtacaccgcattggctcaaaaagctatgtcaagacattttagatgccttaaagatgcagttgcggctcagcttaagcagagttgcgaacttcttggggacaaagatgcagcgggaatctcttcttccgggttaacaaaaggtgaaactccgcgtttgcgtttgctagagcaaagtttgcgtcagcaacgtgcgtttcatcaaatgggtatgatggaacaagaagcttggcggccacaacgcggtttgcctgaacgctccgtcaatatacttagagcttggctcttcgaacatttccttcacccgtatccaagtgatgcagataaacacctattggctcgacagactggtttatccagaaatcaggtatcaaattggttcataaatgctagggttcgtttatggaaaccaatggtggaagaaatgtaccaacaagaatcaaaagaaagagaaagagaagaggaattagaagagaacgaagaagatcaagaaacaaaaaacagcaacgacgacaagagcacaaaatccaacaacaatgaaagcaacttcactgccgttcggaccacttcacaaactccaacgacaaccgcaccagacgcatcagacgcagacgcagcagtagcgacaggccaccgtctaagatccaacattaatgcttacgaaaacgacgcttcatcacttctactcccttcctcttattccaacgccgccgctcctgccgctgtttctgacgacttgaattctcgttacggtggctcagacgcgttttccgccgttgccacgtgtcaacaaagtgtaggtgggttcgatgatgctgacatggatggtgttaacgttataaggtttgggacaaaccctactggtgacgtgtctctcacgcttggtttacgccacgctggaaacatgcctgacaaagacgcttctttctgcgttagagagtttgggggtttttagtttgcttttgtcactccatttaattaattaattatagttttccattcttacttattttaattgaaaatctatttttgtctcttaaaagtccaaacaatacattagtctagccctcctctgcttttttttttctatctcgtgaagagaagaaaacgatacgtaaatcccttcgaaaactaatgtacgttgtacgacttattgttttcataaaaaaaaaaaaaaa

SEQ ID NO: 2330 - protein, 739 aa, Arabidopsis thaliana
  G418
MGITKTSPNTTILLKTFHNNSMSQDYHHHHHHNQHQGGIFNFSNGFDRSDSPNLTTQQKQEHQRVEMDEESSVAGGRIPVYESAGMLSEMFNFPGSSGGGRDLDLGQSFRSNRQLLEEQHQNIPAMNATDSATATAAAMQLFLMNPPPPQQPPSPSSTTSPRSHHNSSTLHMLLPSPSTNTTHHQNYTNHMSMHQLPHQHHQQISTWQSSPDHHHHHHNSQTEIGTVHVENSGGHGGQGLSLSLSSSLEAAAKAEEYRNIYYGANSSNASPHHQYNQFKTLLANSSQHHHQVLNQFRSSPAASSSSMAAVNILRNSRYTTAAQELLEEFCSVGRGFLKKNKLGNSSNPNTCGGDGGGSSPSSAGANKEHPPLSASDRIEHQRRKVKLLTMLEEVDRRYNHYCEQMQMVVNSFDIVMGHGAALPYTALAQKAMSRHFRCLKDAVAAQLKQSCELLGDKDAAGISSSGLTKGETPRLRLLEQSLRQQRAFHQMGMMEQEAWRPQRGLPERSVNILRAWLFEHFLHPYPSDADKHLLARQTGLSRNQVSNWFINARVRLWKPMVEEMYQQESKEREREEELEENEEDQETKNSNDDKSTKSNNNESNFTAVRTTSQTPTTTAPDASDADAAVATGHRLRSNINAYENDASSLLLPSSYSNAAAPAAVSDDLNSRYGGSDAFSAVATCQQSVGGFDDADMDGVNVIRFGTNPTGDVSLTLGLRHAGNMPDKDASFCVREFGGF

SEQ ID NO: 2331 - DNA, 2405 bp, Arabidopsis thaliana
  G419
aagccacacaatctcttttcttctctctctctctgttatatctcttctgtttaattcttttattcttcttcgtctatcttctcctataatctcttctctctccctcttcacctaaagaataagaagaaaaataattcacatctttatgcaaactactttcttgtagggttttaggagctatctctattgtcttggttctgatacaaagttttgtaattttcatggtatgagaagatttgcctttctattttgtttattggttctttttaactttttcttggagatgggttcttgtagatcttaatgaaacttctgtttttgtcccaaaaagagttttcttttttcttctcttctttttgggttttcaattcttgagagacatggcaagagatcagttctatggtcacaataaccatcatcatcaagagcaacaacatcaaatgattaatcagatccaagggtttgatgagacaaaccaaaacccaaccgatcatcatcattacaatcatcagatctttggctcaaactccaacatgggtatgatgatagacttctctaagcaacaacagattaggatgacaagtggttcggatcatcatcatcatcatcatcagacaagtggtggtactgatcagaatcagcttctggaagattcttcatctgccatgagactatgcaatgttaataatgatttcccaagtgaagtaaatgatgagagaccaccacaaagaccaagccaaggtctttccctttctctctcctcttcaaatcctacaagcatcagtctccaatctttcgaactcagaccccaacaacaacaacaagggtattccggtaataaatcaacacaacatcagaatctccaacacacgcagatgatgatgatgatgatgaatagtcaccaccaaaacaacaacaataacaatcatcagcatcataatcatcatcagtttcagattgggagttccaagtatttgagtccagctcaagagctactgagtgagttttgcagtcttggagtaaaggaaagcgatgaagaagtgatgatgatgaagcataagaagaagcaaaagggtaaacaacaagaagagtgggacacaagtcaccacagcaacaatgatcaacatgaccaatctgcgactacttcttcaaagaaacatgttccaccacttcactctcttgagttcatggaacttcagaaaagaaaagccaagttgctctccatgctcgaagagcttaaaagaagatatggacattaccgagagcaaatgagagttgcggcggcagcctttgaagcggcggttggactaggaggggcagagatatacactgcgttagcgtcaagggcaatgtcaagacactttcggtgtttaaaagacggacttgtgggacagattcaagcaacaagtcaagctttgggagagagagaagaggataatcgtgcggtttctattgcagcacgtggagaaactccacggttgagattgctcgatcaagctttgcggcaacagaaatcgtatcgccaaatgactcttgttgacgctcatccttggcgtccacaacgcggcttgcctgaacgcgcagtcacaacgttgagagcttggctctttgaacactttcttcacccatatccgagcgatgttgataagcatatattggcccgacaaactggtttatcaagaagtcaggtatcaaattggtttattaatgcaagagttaggctatggaaaccaatgattgaagaaatgtactgtgaagaaacaagaagtgaacaaatggagattacaaacccgatgatgatcgatactaaaccggacccggaccagttgatccgtgtcgaaccggaatctttatcctcaatagtgacaaaccctacatccaaatccggtcacaactcaacccatggaacgatgtcgttagggtcaacgtttgacttttccttgtacggtaaccaagctgtgacatacgctggtgaaggagggccacgtggtgacgtttccttgacgcttgggttacaacgtaacgatggtaacggtggtgtgagtttagcgttgtctccagtgacggctcaaggtggccaacttttctacggtagagaccacattgaagaaggaccggttcaatattcagcgtcgatgttagatgatgatcaagttcagaatttgccttataggaatttgatgggagctcaattacttcatgatattgtttgagattaaaagattaggaccaaagttatcgatacatattttccaaaaccgattcggttatgtaacggtttagttagataaaaaccaaattagatatttatatataccgttgtctgattggattggaggattggtggacaaggagatattattaatgtatgagttagttggttcgtcaaaaaaaaaaaaaaaaaa

SEQ ID NO: 2332 - protein, 610 aa, Arabidopsis thaliana
  G419
MARDQFYGHNNHHHQEQQHQMINQIQGFDETNQNPTDHHHYNHQIFGSNSNMGMMIDFSKQQQIRMTSGSDHHHHHHQTSGGTDQNQLLEDSSSAMRLCNVNNDFPSEVNDERPPQRPSQGLSLSLSSSNPTSISLQSFELRPQQQQQGYSGNKSTQHQNLQHTQMMMMMMNSHHQNNNNNNHQHHNHHQFQIGSSKYLSPAQELLSEFCSLGVKESDEEVMMMKHKKKQKGKQQEEWDTSHHSNNDQHDQSATTSSKKHVPPLHSLEFMELQKRKAKLLSMLEELKRRYGHYREQMRVAAAAFEAAVGLGGAEIYTALASRAMSRHFRCLKDGLVGQIQATSQALGEREEDNRAVSIAARGETPRLRLLDQALRQQKSYRQMTLVDAHPWRPQRGLPERAVTTLRAWLFEHFLHPYPSDVDKHILARQTGLSRSQVSNWFINARVRLWKPMIEEMYCEETRSEQMEITNPMMIDTKPDPDQLIRVEPESLSSIVTNPTSKSGHNSTHGTMSLGSTFDFSLYGNQAVTYAGEGGPRGDVSLTLGLQRNDGNGGVSLALSPVTAQGGQLFYGRDHIEEGPVQYSASMLDDDQVQNLPYRNLMGAQLLHDIV

SEQ ID NO: 2333 - DNA, 1379 bp, Arabidopsis thaliana
  G428
ttacttttgtgtttcttcatattcttcagaagcaagcacaaggctagggatcgaagaagcggcgatcactgatcgtatctcactacgatcacattaatggatagaatgtgtggtttccgctcgacggaagactattcggagaaagcgacgttgatgatgccgtccgattatcagtctttgatttgttcaaccaccggagacaatcaaagactgtttggatccgacgaactcgctaccgctttgtcctcggagttgcttccgcgtattcgaaaagctgaggataatttctctcttagtgtcatcaaatccaaaatcgcttctcatcctttgtatcctcgcttactccaaacctacatcgattgccaaaaggtgggagcgcctatggaaatagcgtgtatattggaagagattcagcgagagaaccatgtgtacaagagagatgttgctccattatcttgctttggagctgatcctgagcttgatgaattcatggaaacctactgtgatatattggttaaatacaaaaccgatcttgcgaggccgttcgacgaggctacaactttcataaacaagattgaaatgcagcttcagaacttgtgcactggtccagcgtctgctacagctctttcagatgatggtgcggtttcatctgacgaggaactgagagaagatgatgacatagcagcggatgacagccaacaaagaagcaatgaccgcgatctgaaggaccagctactacgcaaatttggtagccatatcagttcattgaaactcgagttctctaaaaagaagaagaaagggaagctaccaagagaagcaagacaagcgttgctcgattggtggaatgttcataataaatggccttaccctactgaaggcgacaaaatagctctggctgaagaaacaggtttggatcaaaaacaaatcaacaattggtttataaaccaaaggaaacgccattggaagccttcggagaacatgccgtttgatatgatggacgattctaatgaaacattctttaccgaggaatgaaaagagagacatgggattgtgcattgtataatttttacactgttttcccaagaaaagaaaacagtaaaaagcttttggtaaatgggacatcatcgcgaatgaatggaaccagttagccaaaacggtcaagggcgtggcgtaacgagacattgtattggaaatagtggcaatattatgtcactaatcttccaatggtccaaaatgatagatttcttatttgtattgaaccttacttagatagctgatgtgtcaactaaataatttattttcatccttatactacttgtatcaatgtctctaattgatcaattgttgcttgctattcaaaaaaaaaaaaaaaaaaaaaa

SEQ ID NO: 2334 - protein, 311 aa, Arabidopsis thaliana
  G428
MDRMCGFRSTEDYSEKATLMMPSDYQSLICSTTGDNQRLFGSDELATALSSELLPRIRKAEDNFSLSVIKSKIASHPLYPRLLQTYIDCQKVGAPMEIACILEEIQRENHVYKRDVAPLSCFGADPELDEFMETYCDILVKYKTDLARPFDEATTFINKIEMQLQNLCTGPASATALSDDGAVSSDEELREDDDIAADDSQQRSNDRDLKDQLLRKFGSHISSLKLEFSKKKKKGKLPREARQALLDWWNVHNKWPYPTEGDKIALAEETGLDQKQINNWFINQRKRHWKPSENMPFDMMDDSNETFFTEE

SEQ ID NO: 2335 - DNA, 1149 bp, Arabidopsis thaliana
  G431
atggagagtggttccaacagcacttcttgtccaatggcttttgccggggataatagtgatggtccgatgtgtcctatgatgatgatgatgccgcccatcatgacatcacatcaacatcatggtcatgatcatcaacatcaacaacaagaacatgatggttatgcatatcagtcacaccaccaacaaagtagttccctttttcttcaatcactagctcctccccaaggaactaagaacaaagttgcttcttcttcttctccttcctcttgtgctcctgcctattctctaatggagatccatcataacgaaatcgttgcaggaggaatcaacccttgctcctctttctcttcttcagcctctgtcaaggccaagatcatggctcatcctcactaccaccgcctcttggccgcttatgtcaattgtcagaaggttggagcaccaccggaggttgtggcgaggctggaggaggcatgctcgtctgccgcagccgcagccgcatctatggggccaacagggtgtcttggtgaagatccagggcttgatcaattcatggaagcttactgtgaaatgctcgttaagtatgagcaagagctctccaaacctttcaaggaagctatggtcttccttcaacgtgtcgagtgtcaattcaaatccctctctctatcctcaccttcctctttctccggttatggagagacagcaattgataggaacaataatgggtcatccgaggaagaagtcgatatgaacaatgaatttgtagatccacaagctgaggatagagagcttaaaggacagctcttgcgcaagtacagtggttacttagggagcctcaagcaagagttcatgaagaagaggaagaaaggaaagctccctaaagaagctcgtcaacaactgcttgattggtggagccgtcactacaaatggccttacccttcggagcaacaaaagctcgcccttgcggaatcaacggggctggaccagaaacagataaacaattggttcataaaccagaggaaacggcattggaagccgtcggaggacatgcagtttgtagtaatggacgcaacacatcctcaccattacttcatggataatgtcttggacaatcctttcccaatggatcacatctcctccaccatgctttga

SEQ ID NO: 2336 - protein, 382 aa, Arabidopsis thaliana
  G431
MESGSNSTSCPMAFAGDNSDGPMCPMMMMMPPIMTSHQHHGHDHQHQQQEHDGYAYQSHHQQSSSLFLQSLAPPQGTKNKVASSSSPSSCAPAYSLMEIHHNEIVAGGINPCSSFSSSASVKAKIMAHPHYHRLLAAYVNCQKVGAPPEVVARLEEACSSAAAAAASMGPTGCLGEDPGLDQFMEAYCEMLVKYEQELSKPFKEAMVFLQRVECQFKSLSLSSPSSFSGYGETAIDRNNNGSSEEEVDMNNEFVDPQAEDRELKGQLLRKYSGYLGSLKQEFMKKRKKGKLPKEARQQLLDWWSRHYKWPYPSEQQKLALAESTGLDQKQINNWFINQRKRHWKPSEDMQFVVMDATHPHHYFMDNVLDNPFPMDHISSTML

SEQ ID NO: 2337 - DNA, 2157 bp, Arabidopsis thaliana
  G436
atggattttactcgcgatgacaactcaagtgatgaacgggaaaatgatgtagacgccaacaccaacaaccgtcacgagaagaagggttaccatcgccacactaatgaacaaattcataggcttgaaacgtatttcaaggaatgtcctcatccagacgaatttcagcgacgtctgttgggtgaagaactgaatctgaaaccaaaacaaatcaaattttggtttcaaaacaaaagaactcaagctaagagtcacaatgaaaaagcagacaatgcagcgcttagggcagaaaatattaagattagacgtgagaacgaatcaatggaagatgcactgaataatgtggtttgccctccatgtggtggtcgtggtcctgggagagaagaccaacttcgacatctccaaaaactccgtgcacaaaacgcttatctcaaagatgagtatgaaagagtctcaaactacctaaaacagtacggaggtcactcaatgcataacgtcgaggccacaccctatctccatggtccatcaaaccatgcatcaacgtccaagaaccgtccagcattgtacggaacctcttctaaccgtctccccgagccttcaagcatatttagaggaccatacactcgtggaaacatgaacaccaccgcaccgcctcagccgcgaaagccgctggaaatgcagaatttccaaccactatctcaactggagaaaattgcaatgttggaagcagcggaaaaagcggtgtcagaggttttgagcctcattcaaatggatgatacaatgtggaaaaagtcgtctattgatgataggctcgtcattgatccagggctctatgagaaatattttactaagactaacacaaatggtcgtcctgagtcttctaaagatgtcgtggtggttcaaatggatgctggaaacttgatcgacatcttcttaactgcggagaaatgggcgaggctttttccaacaattgtgaacgaagctaaaacgattcacgtcttggattccgttgaccatcgaggaaaaactttctcaagagtgatttatgagcaactgcacatactgtcaccattggtgccaccgagggaatttatgatcctaaggacttgccaacaaattgaagacaatgtctggatgattgctgatgtgtcgtgtcatctcccaaacattgagtttgatctttcgtttcccatttgcaccaaacgtccctcaggtgtgctcattcaagccttgccccacggcttctctaaggtgacgtggatagagcatgtggtagtgaatgataatagagtgcggccacataagctttacagagacctcttatacggcggctttggctacggagctcgacgttggaccgttactcttgagaggacgtgtgagaggctgattttctccacctccgtccctgccttgcccaacaatgacaatcccggagttgtgcaaacaatacgaggcagaaatagcgtaatgcatttgggagaaagaatgttgaggaactttgcatggatgatgaaaatggttaacaaactcgacttctcgccacagtctgaaactaacaacagcggaattaggattggggtgcggataaacaatgaggcgggtcaaccgcccggtctcattgtctgtgctggttcatctttatccctccctctccctcctgtccaagtgtacgatttccttaagaatctggaggttcgtcaccagtgggacgttctgtgccatgggaatccagcgactgaggctgctcgtttcgtcaccggatcaaacccaaggaacactgtgtcttttctcgagccttcaattagggatattaatactaagctaatgatactccaagatagcttcaaagatgcattgggaggaatggtggcctacgctccaatggatctaaacaccgcctgcgctgccatttcaggcgatatcgatcctaccaccattccaatcctcccttccggttttatgatctcccgtgacggccgtccttccgagggcgaagccgagggtggcagctatacactcctcaccgtggctttccagatccttgtctccggtccgagttactctcctgataccaacctggaagtttctgccaccacagtcaataccttgattagctccaccgttcaaaggatcaaagccatgctcaagtgcgaatga

SEQ ID NO: 2338 - protein, 718 aa, Arabidopsis thaliana
  G436
MDFTRDDNSSDERENDVDANTNNRHEKKGYHRHTNEQIHRLETYFKECPHPDEFQRRLLGEELNLKPKQIKFWFQNKRTQAKSHNEKADNAALRAENIKIRRENESMEDALNNVVCPPCGGRGPGREDQLRHLQKLRAQNAYLKDEYERVSNYLKQYGGHSMHNVEATPYLHGPSNHASTSKNRPALYGTSSNRLPEPSSIFRGPYTRGNMNTTAPPQPRKPLEMQNFQPLSQLEKIAMLEAAEKAVSEVLSLIQMDDTMWKKSSIDDRLVIDPGLYEKYFTKTNTNGRPESSKDVVVVQMDAGNLIDIFLTAEKWARLFPTIVNEAKTIHVLDSVDHRGKTFSRVIYEQLHILSPLVPPREFMILRTCQQIEDNVWMIADVSCHLPNIEFDLSFPICTKRPSGVLIQALPHGFSKVTWIEHVVVNDNRVRPHKLYRDLLYGGFGYGARRWTVTLERTCERLIFSTSVPALPNNDNPGVVQTIRGRNSVMHLGERMLRNFAWMMKMVNKLDFSPQSETNNSGIRIGVRINNEAGQPPGLIVCAGSSLSLPLPPVQVYDFLKNLEVRHQWDVLCHGNPATEAARFVTGSNPRNTVSFLEPSIRDINTKLMILQDSFKDALGGMVAYAPMDLNTACAAISGDIDPTTIPILPSGFMISRDGRPSEGEAEGGSYTLLTVAFQILVSGPSYSPDTNLEVSATTVNTLISSTVQRIKAMLKCE

SEQ ID NO: 2339 - DNA, 1177 bp, Arabidopsis thaliana
  G439
tataaatcttcgtttctacttttttttcttccataatatagtcaattcgttttcttaattagggcttcttctctttgtttctccaatctttattagtttatttatttattttggttattgtatacaaatggcaatggctttaaacatgaatgcttacgtagacgagttcatggaagctcttgaaccattcatgaaggtaacttcatcttcttctacttcgaattcatcaaatccaaaaccattaactcctaatttcatccctaataatgaccaagtcttaccggtatctaaccaaaccggtccgattgggctaaaccagctcactccaacacaaatcctccaaattcagacagagttacatctccggcaaaaccaatctcgtcgtcgcgctggtagtcatcttctcaccgctaaaccaacctcaatgaagaaaatcgacgtagcaactaaaccggttaaactataccgaggcgtaagacagaggcaatggggtaaatgggtagctgagattcggctacctaaaaaccgaacccggttatggctcggtacgttcgaaacggctcaagaagctgcattagcttacgatcaagcagctcataagatcagaggagacaacgctcgtctcaatttcccagacattgttcgtcaaggacactataaacagatattgtctccgtctatcaacgcaaagatcgaatccatctgcaatagttctgatcttccactgcctcagatcgagaaacagaacaaaacagaggaggtgctctctggtttttccaaaccggagaaagaaccggaatttggggagatatacggatgcggatactcgggctcatctcctgagtcggatataacgttgttggatttctcaagcgactgtgtgaaagaagatgagagtttcttgatgggtttgcacaagtatccttctttggagattgattgggacgctatagagaaactcttctgaatccattttatctttttgattcatttgtctctaaattgtagaattttattttcagagctttgtaagggaagttcttgaatgagagttgcagaggactagtggaacctaactctgttttcttttgtaagtattgtttataatgggccgttgaatgggccttattgatttaaacagcccaagtttttaaaaaaaaaaaaaaaaaaaaaaaaa

SEQ ID NO: 2340 - protein, 279 aa, Arabidopsis thaliana
  G439
MAMALNMNAYVDEFMEALEPFMKVTSSSSTSNSSNPKPLTPNFIPNNDQVLPVSNQTGPIGLNQLTPTQILQIQTELHLRQNQSRRRAGSHLLTAKPTSMKKIDVATKPVKLYRGVRQRQWGKWVAEIRLPKNRTRLWLGTFETAQEAALAYDQAAHKIRGDNARLNFPDIVRQGHYKQILSPSINAKIESICNSSDLPLPQIEKQNKTEEVLSGFSKPEKEPEFGEIYGCGYSGSSPESDITLLDFSSDCVKEDESFLMGLHKYPSLEIDWDAIEKLF

SEQ ID NO: 2341 - DNA, 3829 bp, Arabidopsis thaliana
  G447
ctttttaagagcttaaaaatttgctttgaagcttcaaatattcttatgaactaaaaagaagaaaaaagcttttgtttctttttccttagcagcagaatgatttttgtttccaaaattattactatttagtttctctcgtgctcttctcttgagcaaatacagattcgttaattttgctgaagaagaagaactctgtttcttccctgcaccaaaccaattttttcgttctttctataaaccatgaaagctccatcaaatggatttcttccaagttccaacgaaggagagaagaagccaatcaattctcaactatggcacgcttgtgcagggcctttagtttcattacctcctgtgggaagtcttgtggtttacttccctcaaggacacagcgagcaagttgcagcatcgatgcagaagcaaacagattttataccaaattacccaaatcttccttctaagctgatttgcttgcttcacagtgttacattacatgctgataccgaaacagatgaagtctatgcacaaatgactcttcaacctgtgaataagtatgatagagaagcattgctagcttctgatatgggcttgaagctaaacagacaacctactgagtttttttgcaagactcttactgcaagtgacacaagcactcatggtggattctctgtaccgcgtcgtgcagctgagaaaatattccctcctcttgatttctcgatgcaaccgcctgcgcaagagattgtagctaaagatttacatgatactacatggactttcagacatatctatcgaggccaaccaaaaagacacttgcttaccacaggttggagcgtttttgttagcacaaagagactatttgcgggtgattcagttttgtttgtaagagatgagaaatcacagctgatgttgggtataagacgtgcaaatagacaaactccgactctttcctcatcggtcatatccagcgacagtatgcacattgggatacttgcagctgcagctcatgctaatgccaatagtagcccttttaccatcttcttcaatccaagggcaagtccttcagagtttgtagttcctttagccaaatacaacaaagccttatacgctcaagtatctctaggaatgagattccggatgatgtttgagactgaggattgtggggttcgtagatatatgggtacagtcacaggtattagtgatcttgaccctgtaagatggaaaggctcacaatggcgtaatcttcaggtaggatgggatgaatcaacagctggagataggccaagccgagtatccatatgggaaatcgaacccgtcataactcctttttacatatgtcctcctccatttttcagacctaagtacccgaggcaacccgggatgccagatgatgagttagacatggaaaatgctttcaaaagagcaatgccttggatgggagaagactttgggatgaaggacgcacagagttcgatgttccctggtttaagtctagttcaatggatgagtatgcagcaaaacaatccattgtcaggttctgctactcctcagctcccgtccgcgctctcatcttttaacctaccaaacaattttgcttccaacgacccttccaagctgttgaacttccaatccccaaacctctcttccgcaaattcccaattcaacaaaccgaacacggttaaccatatcagccaacagatgcaagcacaaccagccatggtgaaatctcaacaacaacaacaacaacaacaacaacaacaccaacaccaacaacaacaactgcaacaacaacaacaactacagatgtcacagcaacaggtgcagcaacaagggatttataacaatggtacgattgctgttgctaaccaagtctcttgtcaaagtccaaaccaacctactggattctctcagtctcagcttcagcagcagtcaatgctccctactggtgctaaaatgacacaccagaacataaattctatggggaataaaggcttgtctcaaatgacatcgtttgcgcaagaaatgcagtttcagcagcaactggaaatgcataacagtagccagttattaagaaaccagcaagaacagtcctctctccattcattacaacaaaatctgtcccaaaatcctcagcaactccaaatgcaacaacaatcatcaaaaccaagtccttcacaacagcttcagttgcagctactgcagaagctacagcagcagcaacagcagcagtcgattcctccagtaagctcatccttacagccacaattatcagcgttgcagcagacacaaagccatcaattgcaacaacttctgtcgtctcaaaatcaacagcccttggcacatggtaataacagcttcccagcttcaactttcatgcagcctccacagattcaggtgagtcctcagcagcaaggacagatgagtaacaaaaatcttgtagccgctggaagatcacattctggccacacagatggagaagctccttcttgttcaacctcaccttccgccaataacacgggacatgataatgtttcaccgacaaatttcctgagcagaaatcaacagcaaggacaagctgcatctgtatctgcatctgattcagtctttgagcgcgcaagcaatccggtccaagagctttatacaaaaactgagagccggatcagtcaaggcatgatgaatatgaagagtgctggtgaacatttcagatttaaaagcgcggtaacagatcaaatcgatgtatccacagcgggaacgacgtactgtcctgatgttgttggccctgtacagcagcaacaaactttcccactaccatcatttggttttgatggagactgccaatctcatcatccaagaaacaacttagctttccctggtaatctcgaagccgtaacttctgatccactctattctcaaaaggactttcaaaacttggttcccaactatggcaacacaccaagagacattgagacggagctgtccagtgctgcaatcagttctcagtcatttggtattcccagcattccctttaagcccggatgttcaaatgaggttggcggcatcaatgattcaggaatcatgaatggtggaggactgtggcccaatcagactcaacgaatgcgaacatatacaaaggttcaaaaacgagggtcagtaggtagatcaatagatgttacccgttatagcggctatgatgaacttaggcatgacttagcgagaatgtttggcatcgaaggacagctcgaagatccgctaacctctgattggaaactcgtctacaccgatcacgaaaacgatattttactagttggtgatgatccttgggaagagtttgtgaactgcgtgcagaacataaagatactatcatcagtagaagttcagcaaatgagcttagacggagatcttgcagctatcccaaccacaaaccaagcctgcagcgaaacagacagcggaaatgcttggaaagtacactatgaagacacttctgctgcagcttctttcaacagatagaaataaaaagatgcaaatataccaagtcaacttacattatcattcgaggccatcgcaaagtacatgtttttttttgtgtgtatgtactgcaaacaacaaactgagaagaagaagatactgcacggtatataaacatttttataggacagtgatttgatttttcattctaacttgatgttgttgtactttcttgtttccatatttgtataacaagtataatgcttgacaagtctatgaggagcatatcttatacagagatactaagatgtaatgttaatgtaactaaacaattaccttcattaatcatgaatcctttggtcgtttaaaa

SEQ ID NO: 2342 - protein, 1086 aa, Arabidopsis thaliana
  G447
MKAPSNGFLPSSNEGEKKPINSQLWHACAGPLVSLPPVGSLVVYFPQGHSEQVAASMQKQTDFIPNYPNLPSKLICLLHSVTLHADTETDEVYAQMTLQPVNKYDREALLASDMGLKLNRQPTEFFCKTLTASDTSTHGGFSVPRRAAEKIFPPLDFSMQPPAQEIVAKDLHDTTWTFRHIYRGQPKRHLLTTGWSVFVSTKRLFAGDSVLFVRDEKSQLMLGIRRANRQTPTLSSSVISSDSMHIGILAAAAHANANSSPFTIFFNPRASPSEFVVPLAKYNKALYAQVSLGMRFRMMFETEDCGVRRYMGTVTGISDLDPVRWKGSQWRNLQVGWDESTAGDRPSRVSIWEIEPVITPFYICPPPFFRPKYPRQPGMPDDELDMENAFKRAMPWMGEDFGMKDAQSSMFPGLSLVQWMSMQQNNPLSGSATPQLPSALSSFNLPNNFASNDPSKLLNFQSPNLSSANSQFNKPNTVNHISQQMQAQPAMVKSQQQQQQQQQQHQHQQQQLQQQQQLQMSQQQVQQQGIYNNGTIAVANQVSCQSPNQPTGFSQSQLQQQSMLPTGAKMTHQNINSMGNKGLSQMTSFAQEMQFQQQLEMHNSSQLLRNQQEQSSLHSLQQNLSQNPQQLQMQQQSSKPSPSQQLQLQLLQKLQQQQQQQSIPPVSSSLQPQLSALQQTQSHQLQQLLSSQNQQPLAHGNNSFPASTFMQPPQIQVSPQQQGQMSNKNLVAAGRSHSGHTDGEAPSCSTSPSANNTGHDNVSPTNFLSRNQQQGQAASVSASDSVFERASNPVQELYTKTESRISQGMMNMKSAGEHFRFKSAVTDQIDVSTAGTTYCPDVVGPVQQQQTFPLPSFGFDGDCQSHHPRNNLAFPGNLEAVTSDPLYSQKDFQNLVPNYGNTPRDIETELSSAAISSQSFGIPSIPFKPGCSNEVGGINDSGIMNGGGLWPNQTQRMRTYTKVQKRGSVGRSIDVTRYSGYDELRHDLARMFGIEGQLEDPLTSDWKLVYTDHENDILLVGDDPWEEFVNCVQNIKILSSVEVQQMSLDGDLAAIPTTNQACSETDSGNAWKVHYEDTSAAASFNR

SEQ ID NO: 2343 - DNA, 1128 bp, Arabidopsis thaliana
  G479
atggagatgggttccaactcgggtccgggtcatggtccgggtcaggcagagtcgggtggttcctccactgagtcatcctctttcagtggagggctcatgtttggccagaagatctacttcgaggacggtggtggtggatccgggtcttcttcctcaggtggtcgttcaaacagacgtgtccgtggaggcgggtcgggtcagtcgggtcagataccaaggtgccaagtggaaggttgtgggatggatctaaccaatgcaaaaggttattactcgagacaccgagtttgtggagtgcactctaaaacacctaaagtcactgtggctggtatcgaacagaggttttgtcaacagtgcagcaggtttcatcagcttccggaatttgacctagagaaaaggagttgccgcaggagactcgctggtcataatgagcgacgaaggaagccacagcctgcgtctctctctgtgttagcttctcgttacgggaggatcgcaccttcgctttacgaaaatggtgatgctggaatgaatggaagctttcttgggaaccaagagataggatggccaagttcaagaacattggatacaagagtgatgaggcggccagtgtcgtcaccgtcatggcagatcaatccaatgaatgtatttagtcaaggttcagttggtggaggagggacaagcttctcatctccagagattatggacactaaactagagagctacaagggaattggcgactcaaactgtgctctctctcttctgtcaaatccacatcaaccacatgacaacaacaacaacaacaacaacaacagcaacaacaacaacaatacatggcgagcttcttcaggttttggcccgatgacggttacaatggctcaaccaccacctgcacctagccagcatcagtatctgaacccgccttgggtattcaaggacaatgataatgatatgtctcctgttttgaatttaggtcgatacaccgagccagataattgtcagataagtagtggcacggcaatgggtgagttcgagttatctgatcaccatcatcaaagtaggagacagtacatggaagatgagaacacaagggcttatgactcttcttctcaccataccaactggtctctctga

SEQ ID NO: 2344 - protein, 375 aa, Arabidopsis thaliana
  G479
MEMGSNSGPGHGPGQAESGGSSTESSSFSGGLMFGQKIYFEDGGGGSGSSSSGGRSNRRVRGGGSGQSGQIPRCQVEGCGMDLTNAKGYYSRHRVCGVHSKTPKVTVAGIEQRFCQQCSRFHQLPEFDLEKRSCRRRLAGHNERRRKPQPASLSVLASRYGRIAPSLYENGDAGMNGSFLGNQEIGWPSSRTLDTRVMRRPVSSPSWQINPMNVFSQGSVGGGGTSFSSPEIMDTKLESYKGIGDSNCALSLLSNPHQPHDNNNNNNNNSNNNNNTWRASSGFGPMTVTMAQPPPAPSQHQYLNPPWVFKDNDNDMSPVLNLGRYTEPDNCQISSGTAMGEFELSDHHHQSRRQYMEDENTRAYDSSSHHTNWSL

SEQ ID NO: 2345 - DNA, 1179 bp, Arabidopsis thaliana
  G525
cttctctcttctcaaaaacccttccctcttcgtctccaaacaacaacaaacacaacaacaacaaaaatcttacaagaagatcatttttagaaaccctattaggataaaatggattacgaggcatcaagaatcgtcgaaatggtagaagatgaagaacatatagatctaccaccaggattcagatttcaccctactgatgaagaactcataactcactacctcaaaccaaaggttttcaacactttcttctctgctactgccattggtgaagttgatctcaacaagattgagccttgggacttaccatggaaggctaagatgggagaaaaagaatggtatttcttctgtgtgagagaccggaaatacccgaccggtttaaggacaaaccgggcgacagaagccggttattggaaagccacaggaaaagacaaagagatattcaagggaaaatcacttgtgggtatgaagaaaactttggttttctataaaggaagagctcctaaaggagttaaaaccaattgggttatgcatgaatatcgtttagaaggcaaatattgtattgaaaatcttccccaaacagctaagaacgaatgggttatatgtcgtgttttccaaaaacgtgccgatggtacaaaggttccaatgtcaatgcttgatccacacattaaccgaatggaaccagccggtttaccttcgttaatggattgttctcaacgagactccttcaccggttcgtcgtctcacgtgacctgcttctccgaccaagaaaccgaagacaaaagacttgtccacgagtccaaagacggttttggttctctgttttactcggatcctctgtttttacaagacaattattcgctaatgaagctgttgcttgacggtcaagaaactcaattctccggcaaacctttcgacggtcgtgattcgtccggtacagaagaattggattgcgtttggaatttctgagttgtataagttatgttgtagacttgtagtagtcatgtgttcgtgtgtgtgaatgaatattcttgttacatttttttgtaaaaaaggagaaaaaaatatgctagaaagtcaattgcttttgttatgtagcattagtgttttttatgtactcaatagacttcctaattaaataaaaatcttaatttatttgccaaaaaaaaaaaaaaaaaaaaa

SEQ ID NO: 2346 - protein, 285 aa, Arabidopsis thaliana
  G525
MDYEASRIVEMVEDEEHIDLPPGFRFHPTDEELITHYLKPKVFNTFFSATAIGEVDLNKIEPWDLPWKAKMGEKEWYFFCVRDRKYPTGLRTNRATEAGYWKATGKDKEIFKGKSLVGMKKTLVFYKGRAPKGVKTNWVMHEYRLEGKYCIENLPQTAKNEWVICRVFQKRADGTKVPMSMLDPHINRMEPAGLPSLMDCSQRDSFTGSSSHVTCFSDQETEDKRLVHESKDGFGSLFYSDPLFLQDNYSLMKLLLDGQETQFSGKPFDGRDSSGTEELDCVWNF

SEQ ID NO: 2347 - DNA, 1481 bp, Arabidopsis thaliana
  G526
cgacccacgcgtccgagattctctcccagctagctttctcaattcatttttctttcttcatcttcttcttgtgtgatctctctttccaaataagcttatcattcttacaaaaatatttctgggtttctgatattgttcttgttctcttgaatctttattacttgaaaaacatataaagtgatggcggttgtggttgaagaaggtgtggtgttgaatcatggaggtgaagagcttgtggatttgccacctggtttcaggtttcatccaacagacgaagagatcataacatgttaccttaaggagaaggttttaaacagccgattcacggctgtggccatgggagaagctgatctcaacaagtgtgagccttgggatttgccaaagagggcaaagatgggggagaaagagttctacttcttctgtcaaagggacaggaagtatccgactgggatgaggacgaaccgtgcgacggagtcaggatactggaaagccaccgggaaggataaggagatcttcaaaggcaaaggttgtctcgttgggatgaagaaaacacttgtgttttatagaggaagagctccaaaaggtgaaaagactaattgggtcatgcatgaatatcgtcttgaaggcaaatattcgtattacaatctcccaaaatctgcaagggacgaatgggtcgtgtgtagggtttttcacaagaacaatccttctaccacaacccaaccaatgacgagaatacccgttgaagatttcacaaggatggattctctagagaacattgatcatctcctagacttctcatctcttcctcctctcatagacccgagtttcatgagtcaaaccgaacaaccaaacttcaaacccatcaaccctccaacttacgatatctcatcaccaatccaaccccatcatttcaattcttaccaatcaatctttaaccaccaggtttttggttctgcttcgggctctacgtacaacaacaacaacgagatgatcaagatggagcaatcacttgttagtgtatctcaagaaacatgcctaagctcagatgtgaacgcgaacatgactacaaccacggaggtatcttcgggtcctgtaatgaaacaagaaatggggatgatgggaatggtgaatggtagcaagtcgtatgaagatctatgtgacttgaggggggacttgtgggacttctaattaatcatttgactgtggtgaaagagtatatttgttgggatttaaatcatgttagttaatacatatacatataggatttactagaggcttaatcctagttaactattttcacttcattgatattatttaattagttgattgtttaattagtttatactttatagtgtggttaaaaaagaaaagaaaggattgtgataatttgggattttagtgcataagttatatctcaatgtaaactgtatttgtatccaaaaaaaaaaaaaaaaaaaaaaaaaaaaaaaaaaaaaaaaaaa

SEQ ID NO: 2348 - protein, 335 aa, Arabidopsis thaliana
  G526
MAVVVEEGVVLNHGGEELVDLPPGFRFHPTDEEIITCYLKEKVLNSRFTAVAMGEADLNKCEPWDLPKRAKMGEKEFYFFCQRDRKYPTGMRTNRATESGYWKATGKDKEIFKGKGCLVGMKKTLVFYRGRAPKGEKTNWVMHEYRLEGKYSYYNLPKSARDEWVVCRVFHKNNPSTTTQPMTRIPVEDFTRMDSLENIDHLLDFSSLPPLIDPSFMSQTEQPNFKPINPPTYDISSPIQPHHFNSYQSIFNHQVFGSASGSTYNNNNEMIKMEQSLVSVSQETCLSSDVNANMTTTTEVSSGPVMKQEMGMMGMVNGSKSYEDLCDLRGDLWDF

SEQ ID NO: 2349 - DNA, 768 bp, Arabidopsis thaliana
  G536
atgtcgacaagggaagagaatgtttacatggcgaaattagccgaacaagctgaacgttacgaagaaatggttgaattcatggagaaagttgcgaaaactgttgatgttgaggaactttcagttgaagagaggaatcttctctctgttgcttacaagaacgtgattggagcgagaagagcttcgtggagaatcatttcttcgattgagcagaaagaagagagcaaagggaacgaagatcatgttgctattatcaaggattacagaggagagattgaatccgagcttagcaaaatctgtgatgggattttgaatgttcttgaagctcatcttattccttctgcttcaccagctgaatctaaagtgttttatcttaagatgaagggtgattatcataggtatcttgctgagtttaaggctggtgctgaaaggaaagaagctgctgaaagcactttggttgcttacaagtctgcttccgacattgccactgctgagttagctcctactcacccgataaggcttggtcttgcactcaacttctctgtgttttactatgaaatcctcaactcgcctgatcgtgcttgcagcctcgcaaagcaggcgtttgatgatgcaatcgctgagttagatacattgggtgaggaatcatacaaggacagtacactgattatgcagcttcttagagacaatctcactctctggacttcagatatgactgacgaagcaggagatgagattaaggaggcatcaaagcccgatggtgccgagtaa

SEQ ID NO: 2350 - protein, 255 aa, Arabidopsis thaliana
  G536
MSTREENVYMAKLAEQAERYEEMVEFMEKVAKTVDVEELSVEERNLLSVAYKNVIGARRASWRIISSIEQKEESKGNEDHVAIIKDYRGEIESELSKICDGILNVLEAHLIPSASPAESKVFYLKMKGDYHRYLAEFKAGAERKEAAESTLVAYKSASDIATAELAPTHPIRLGLALNFSVFYYEILNSPDRACSLAKQAFDDAIAELDTLGEESYKDSTLIMQLLRDNLTLWTSDMTDEAGDEIKEASKPDGAE

SEQ ID NO: 2351 - DNA, 1374 bp, Arabidopsis thaliana
  G550
atggctgatccggcgattaagctctttggaaagacgattcctttacctgagcttggtgttgttgattcttcttctagctataccggatttttaaccgaaactcagattcctgttcggttatcagattcgtgtaccggcgatgatgatgatgaagagatgggtgattccggtttaggacgagaagaaggtgatgatgttggtgatggtggaggagagagcgagactgataaaaaggaagaaaaagatagtgagtgtcaggaagagtcattgaggaatgaatctaatgatgttactactactacatcgggtataactgaaaaaacggaaacaacaaaagctgcaaagacgaatgaagagtcaggtggtactgcttgctctcaagaggggaagttaaagaaacctgataagattctaccgtgtccgcgatgtaacagcatggaaaccaagttctgttactacaacaactataatgttaaccaacctcgccatttctgcaagaaatgtcagagatattggacagctggtggaacgatgaggaatgttccggttggtgctgggagacgtaagaataagagtccagcttctcattataaccgtcatgtaagtataacatctgcggaagctatgcagaaggtggcgagaactgatcttcaacatcctaatggtgcaaatcttctcacttttggctctgattctgtgctttgtgaatctatggcttctggattgaatcttgttgagaagtcattgttgaagacacaaactgtattgcaagaacccaatgaaggcttgaagattacggttccgttaaaccagacaaacgaagaagctggaacagtcagcccgttaccaaaagttccatgctttccaggaccaccaccaacttggccttacgcttggaacggagtttcgtggacgattttaccgttttaccctccaccggcttactggagctgcccgggggtttcaccgggggcatggaacagcttcacatggatgccacaacccaattcaccatctggttccaatccaaattctcctacactaggtaaacattcacgtgacgagaacgctgctgaaccaggaaccgcttttgatgaaaccgagtcacttggtagggagaaaagcaaacccgagagatgcttgtgggttcccaagacgctgaggattgatgatccagaggaagctgctaaaagttccatctgggaaacattagggatcaaaaaagacgaaaatgcggatactttcggagctttcagatcatcaaccaaagaaaaaagcagtctttctgaaggaagacttccgggaagaagaccggagttgcaagcgaatcctgctgctctttctaggtcagcaaacttccatgagagctcatag

SEQ ID NO: 2352 - protein, 457 aa, Arabidopsis thaliana
  G550
MADPAIKLFGKTIPLPELGVVDSSSSYTGFLTETQIPVRLSDSCTGDDDDEEMGDSGLGREEGDDVGDGGGESETDKKEEKDSECQEESLRNESNDVTTTTSGITEKTETTKAAKTNEESGGTACSQEGKLKKPDKILPCPRCNSMETKFCYYNNYNVNQPRHFCKKCQRYWTAGGTMRNVPVGAGRRKNKSPASHYNRHVSITSAEAMQKVARTDLQHPNGANLLTFGSDSVLCESMASGLNLVEKSLLKTQTVLQEPNEGLKITVPLNQTNEEAGTVSPLPKVPCFPGPPPTWPYAWNGVSWTILPFYPPPAYWSCPGVSPGAWNSFTWMPQPNSPSGSNPNSPTLGKHSRDENAAEPGTAFDETESLGREKSKPERCLWVPKTLRIDDPEEAAKSSIWETLGIKKDENADTFGAFRSSTKEKSSLSEGRLPGRRPELQANPAALSRSANFHESS

SEQ ID NO: 2353 - DNA, 708 bp, Arabidopsis thaliana
  G551
atggagtggtcaacaacgagcaacgtagaaaacgtgagagtagctttcatgccaccgccatggccggagtctagttcctttaactcgctccacagcttcaactttgatccttacgcaggaaattcatatacgcctggcgatacacaaaccggaccggttatctctgtaccggaatcagaaaagatcatgaatgcgtaccgatttccgaacaacaacaatgagatgataaaaaagaagagactaacgagtggacaattagcttcacttgagcgaagttttcaagaagagatcaaattagattcagacaggaaggtgaagctgtcgagagagctcggtctgcagccacgtcagatagcagtttggttccaaaaccgccgtgcacggtggaaggcgaagcagcttgagcagttgtacgactcgcttagacaagagtacgacgtcgtttctagggagaaacaaatgttacacgatgaggtgaagaagctgagagctttactaagagaccagggtttgatcaagaagcaaatctctgccgggaccatcaaagtttccggtgaggaagacacggtggagatttcatcggtggtggtagctcatccaagaacggagaatatgaacgcaaatcaaatcaccggagggaatcaagtttacggtcaatacaacaatccgatgctggttgcttcctctggctggccgtcatacccctga

SEQ ID NO: 2354 - protein, 235 aa, Arabidopsis thaliana
  G551
MEWSTTSNVENVRVAFMPPPWPESSSFNSLHSFNFDPYAGNSYTPGDTQTGPVISVPESEKIMNAYRFPNNNNEMIKKKRLTSGQLASLERSFQEEIKLDSDRKVKLSRELGLQPRQIAVWFQNRRARWKAKQLEQLYDSLRQEYDVVSREKQMLHDEVKKLRALLRDQGLIKKQISAGTIKVSGEEDTVEISSVVVAHPRTENMNANQITGGNQVYGQYNNPMLVASSGWPSYP

SEQ ID NO: 2355 - DNA, 842 bp, Arabidopsis thaliana
  G557
cagagatctgacggcggtagcagagtaatctattccttcccaaaatgtctcgcaattagattctttccaagttcttctgtaaatcccaagtcccgctcttttcctctttatccttttcaccagcttcgctactaagacaacaaatctttccctctctctctcgcctgatcgatcttcaaagagtaagaaaaatgcaggaacaagcgactagctctttagctgcaagctctttaccatcaagcagcgagaggtcatcaagctctgctccacatttggagatcaaagaaggaattgaaagcgatgaggagatacggcgagtgccggagtttggaggagaagctgtcggaaaagaaacttccggtagagaatctggatcggcgaccggtcaggagcggacacaggcgactgtcggagaaagtcaaaggaagcgagggaggacaccggcggagaaagagaacaagcggctgaagaggttgttgaggaacagagtttcagctcagcaagcaagagagaggaaaaaggcttacttgagcgagttggaaaacagagtgaaagacttggagaacaaaaactctgaacttgaagagcgactctctactcttcagaacgagaaccagatgcttagacatattctgaagaacacaacaggaaacaagagaggaggtggtggtggttctaatgctgatgcaagcctttgatctccttcttcttcttgtgttatatttttgtggataaaatttacagagaattgtatcaataattatcatgttaaaattatatgggatgtgagagctaatattgcaattgtagaccaagttctcttaaaaaaaaaaaaaaaaaaa

SEQ ID NO: 2356 - protein, 168 aa, Arabidopsis thaliana
  G557
MQEQATSSLAASSLPSSSERSSSSAPHLEIKEGIESDEEIRRVPEFGGEAVGKETSGRESGSATGQERTQATVGESQRKRGRTPAEKENKRLKRLLRNRVSAQQARERKKAYLSELENRVKDLENKNSELEERLSTLQNENQMLRHILKNTTGNKRGGGGGSNADASL

SEQ ID NO: 2357 - DNA, 1407 bp, Arabidopsis thaliana
  G559
aaagttgctagctttaatttgccaacttactattcttatgtgtaataatcgtttgcagggtcgttgatttggtgataagtcagtagaaatggataaggagaaatctccagcacctccttgtggaggtcttcctcctccatctccatcaggtcgatgctctgcattctcagaagctggtcccattggtcatggttcagatgctaatcgaatgagtcatgatattagccgtatgcttgataacccacctaagaagattggacatcggcgagctcattctgaaatacttactctccctgatgatttgagctttgatagtgatcttggtgtggttggtaatgctgctgatggagcttctttctctgatgagactgaagaagatttgctctctatgtatcttgatatggataagtttaattcttctgctacatcttctgcccaagttggtgagccatcaggaactgcttggaaaaatgagacaatgatgcagacaggcacaggctcaacttccaatcctcagaatacggttaatagtcttggcgaaaggccaagaatcaggcatcaacatagccaatctatggatggttcaatgaatatcaatgagatgcttatgtcgggaaatgaagatgattctgctattgatgctaagaagtctatgtctgctactaaacttgctgagcttgctctcattgatcctaaacgtgctaagaggatatgggcaaacaggcagtccgcagcacgatcaaaagaaaggaagacgagatacatatttgagcttgagagaaaagtacagactttgcaaacagaggctacaactctctcagcccagttgaccctcttacagagagacacaaatggcttgactgttgaaaacaatgagctgaagctgcggttacaaacaatggagcagcaggttcacttgcaggatgaactaaacgaagcactaaaggaggaaatccagcatctgaaggtgttgactggccaagttgctccatcagcgttgaactatgggtcgtttggatcaaaccagcagcaattctattccaacaatcagtcaatgcaaacaatcttagctgcaaaacagttccagcaacttcagattcattcacagaagcagcaacaacaacaacaacaacaacaacagcaacaccaacagcagcagcagcaacagcaacagtatcagtttcaacagcaacagatgcaacagcttatgcagcagcggcttcaacagcaagaacaacaaaatggagtaagactcaagccttcacaagcccagaaagagaactgaggaatatgaatatgtcccacgtaagtgagaggttctccttctgaacaattcctttctcattcataaattgttgttcatccatcacttgcagtctcttggattttagggttttagctaacaca

SEQ ID NO: 2358 - protein, 398 aa, Arabidopsis thaliana
  G559
MDKEKSPAPPCGGLPPPSPSGRCSAFSEAGPIGHGSDANRMSHDISRMLDNPPKKIGHRRAHSEILTLPDDLSFDSDLGVVGNAADGASFSDETEEDLLSMYLDMDKFNSSATSSAQVGEPSGTAWKNETMMQTGTGSTSNPQNTVNSLGERPRIRHQHSQSMDGSMNINEMLMSGNEDDSAIDAKKSMSATKLAELALIDPKRAKRIWANRQSAARSKERKTRYIFELERKVQTLQTEATTLSAQLTLLQRDTNGLTVENNELKLRLQTMEQQVHLQDELNEALKEEIQHLKVLTGQVAPSALNYGSFGSNQQQFYSNNQSMQTILAAKQFQQLQIHSQKQQQQQQQQQQQHQQQQQQQQQYQFQQQQMQQLMQQRLQQQEQQNGVRLKPSQAQKEN

SEQ ID NO: 2359 - DNA, 1370 bp, Arabidopsis thaliana
  G569
gtcgacccacgcgtccgggtttttcttttatcctcttatcgctaatctggagctctatatagactataaagggtttttgattgattcgggagctcgagatttgacttcttttagctgattcggcaagtttgtatctagaaaggatcgattggtgaggtcaatagtggttggtgggttttagtaatggaagacggtgagcttgatttctccaatcaggaagtgttttcgagttcggagatgggtgaattaccacctagcaattgttcgatggatagtttctttgatgggcttttaatggatactaatgctgcttgtacccacactcacacctgtaaccccactggaccagagaacactcatactcacacgtgcttccatgtccacaccaagattctcccggatgagagcgatgaaaaagtttctactgatgatacagctgagtcttgtgggaagaagggtgaaaagagacctttgggaaaccgggaagcggttagaaagtatagagagaagaagaaggctaaagctgcttctttggaggatgaggttgcaaggcttagggcggtgaatcagcagctggtgaagaggttgcaaaatcaggctaccttggaagctgaggtttcgaggcttaagtgtttgcttgtggatttgagaggaagaatagatggagagattggatcttttccttatcagaaacctatggctgcaaatattccttctttctcgcacatgatgaatccttgtaatgtacaatgtgatgatgaagtttattgccctcagaatgtgtttggagtgaatagccaagaaggtgcctcgatcaatgaccaagggttaagtggttgtgattttgatcagctacaatgcatggctaatcagaacttaaatggaaatggaaacggatcattcagcaacgtcaatacatctgtctcgaataagagaaaaggtgggcatcgtgcatcaagagcagtttgaagcatcatcaagcttgtactatctatttccaccagcatagatattgtattccaaataagttgtagagttcagctgcaggatcagcttcgctcagctttgaggggttggtggtgtggtctttctttgtggcacgagtgagatctatggacagaacccagatttagtagtagtagaggcaggatttcgacttccactaaccatcatgttgcttggtgaagaacaaggtatgcccatgaagcacactgttttgtacattgagcttgaggggctgtctctgatctagccttactgtaacattgcaacgttctcacaattgtgatcccaagttgctttgttgacttaaatgtgataatatagcttaacttttacttgaaaaaaaaaaaaaaaaaaaaaaaaaaaaa

SEQ ID NO: 2360 - protein, 261 aa, Arabidopsis thaliana
  G569
MEDGELDFSNQEVFSSSEMGELPPSNCSMDSFFDGLLMDTNAACTHTHTCNPTGPENTHTHTCFHVHTKILPDESDEKVSTDDTAESCGKKGEKRPLGNREAVRKYREKKKAKAASLEDEVARLRAVNQQLVKRLQNQATLEAEVSRLKCLLVDLRGRIDGEIGSFPYQKPMAANIPSFSHMMNPCNVQCDDEVYCPQNVFGVNSQEGASINDQGLSGCDFDQLQCMANQNLNGNGNGSFSNVNTSVSNKRKGGHRASRAV

SEQ ID NO: 2361 - DNA, 1888 bp, Arabidopsis thaliana
  G571
tagccgacctctcttctctcttctgaaaaaaacaccaaaggagctttaaatgctccgttacataatctctatctctttccaagaatatagagaaaggaaaataatatacaagaattaaaagaaggtatatcatcatctctctagctagtgatcaaagcaccgtcatcatcatcatatatcatcagcttgcctcagaggagaagaccaacataagagagatcgaagatcaaaatctatctctcttcatcatcttctgctgttactatcatatcacacgctctctcaaacatcatcctatatatagacttctcttcatcatcatcaaatgcaaggtcatcaccagaatcatcatcaacacttatcatcatcctccgccacgtcttcccatggaaacttcatgaacaaagatgggtatgatattggagagatagacccatcactcttcctctatcttgatggacaaggacatcatgatcctccatcaactgctccttctcctttacatcatcatcacacaactcagaatttggcgatgagacctccaacatcgacgctcaacatctttccatctcagcctatgcacatagagccacctccttcttctacacacaataccgataatacaagattagttccggctgctcaacctagtggttccactcgaccagcttctgacccgtccatggacttgaccaatcattctcagtttcatcaacctcctcaaggttctaaatccatcaagaaggaagggaaccgcaagggtcttgcctcatcggaccatgacatacctaaatcgtcagaccctaaaacattgagaagactagcacaaaacagagaagcagcaagaaaaagcagattacgtaaaaaggcttatgttcagcaactcgagtcatgtaggatcaaactgacccaactagaacaagagattcaacgggccagatcccaaggcgtattctttggagggtctcttataggaggagatcaacagcaaggtggactacccattggccctggcaacatcagctctgaagcagcggtgttcgatatggaatatgcgaggtggctggaggagcagcagaggctattaaacgaactaagggtggcaacacaagaacacttgtccgagaacgagcttaggatgtttgtggacacatgtttagctcattatgaccatttgattaacctcaaggctatggtcgctaagaccgatgtcttccacctcatttctggagcatggaaaactccagctgaacgttgcttcttgtggatgggtggtttccgtccatcggagatcattaaggtgattgtgaaccagatagaaccattgacggagcaacagatagttgggatatgtgggctgcaacagtccacacaagaggccgaggaggctctctcgcaaggcctcgaggcgttgaatcaatcactttccgatagcattgtctctgactccctcccgcctgcctccgcaccacttcctcctcatctatccaatttcatgtcacacatgtccttagctctcaacaagctctctgctctcgagggcttcgttctccaggcggataatttgaggcaccaaacgatccataggctgaaccaattgttgacgacccgtcaagaagcacggtgtcttctagccgttgcggagtacttccaccgtcttcaagctctaagttctctctggctagcccgtcctcggcaagatggataatactaaaacaactgatgaaggaaaccaaaaacaaaaacaagagaataggttgattagttagccgccagcttgacctctttatcatatatatcgtctctctactcaaatacagtgcaattagggaaaattgtttggcttctttttggtatatgattcttactattatgtttttaatcaaga

SEQ ID NO: 2362 - protein, 460 aa, Arabidopsis thaliana
  G571
MQGHHQNHHQHLSSSSATSSHGNFMNKDGYDIGEIDPSLFLYLDGQGHHDPPSTAPSPLHHHHTTQNLAMRPPTSTLNIFPSQPMHIEPPPSSTHNTDNTRLVPAAQPSGSTRPASDPSMDLTNHSQFHQPPQGSKSIKKEGNRKGLASSDHDIPKSSDPKTLRRLAQNREAARKSRLRKKAYVQQLESCRIKLTQLEQEIQRARSQGVFFGGSLIGGDQQQGGLPIGPGNISSEAAVFDMEYARWLEEQQRLLNELRVATQEHLSENELRMFVDTCLAHYDHLINLKAMVAKTDVFHLISGAWKTPAERCFLWMGGFRPSEIIKVIVNQIEPLTEQQIVGICGLQQSTQEAEEALSQGLEALNQSLSDSIVSDSLPPASAPLPPHLSNFMSHMSLALNKLSALEGFVLQADNLRHQTIHRLNQLLTTRQEARCLLAVAEYFHRLQALSSLWLARPRQDG

SEQ ID NO: 2363 - DNA, 2290 bp, Arabidopsis thaliana
  G577
aaaaacagactgagagagagagagagagagtgtgttgttggccatgggatgcacggcctccaagctcgacagtgaggatgctgtccgtcgctgcaaggagcggcgccgtcttatgaaggacgccgtctacgctcgtcaccatctcgccgccgctcactctgactactgccgctcccttcgtctcactggctctgccctctcctccttcgccgccggcgagcccctctccgtctccgagaatactcccgctgtttttctccgcccttcctccagtcaggacgcgccacgtgtcccttcttcccattccccagaaccccctcctccgcccatccgcagcaagcctaagcctactaggcctaggaggcttccacacattctctccgactcctctccttcttcctctcctgccaccagtttctatcccactgctcaccagaactctacttactctcgctctccatctcaagcttcctctgtctggaactgggagaatttctaccctccctctccccccgactccgagtacttcgaacgcaaagctcgccagaaccacaagcaccgtcctccttccgactacgacgccgaaactgaaagatccgaccacgattactgccactcacggagagatgccgccgaggaagttcactgcagcgagtggggcgacgaccacgaccgtttcactgccacctcttcgtccgacggagatggggaggtcgaaactcacgtttccagatccggtattgaagaagagcctgtgaaacaaccacatcaagacccaaatggcaaagagcactctgaccatgttaccacttcttccgactgctacaagaccaaattggtggtaaggcacaagaatttgaaggagatccttgacgccgttcaagactacttcgacaaggctgcctccgctggggaccaggtctccgccatgcttgagatcggccgggctgagctcgaccgcagcttcagcaagctgaggaagacggtgtatcattcaagcagtgtgttcagcaacttgagcgcaagctggacctcaaaacccccattggcagtcaaatacaagctcgatgcatctaccctgaatgatgaacaaggcggcctcaagagcctctgctccactctagaccgactcctcgcttgggaaaagaagctttatgaggatgtcaaggcaagagaaggagttaagattgagcacgagaagaagctgtctgcgctgcagagtcaggagtataagggaggtgatgaatccaagctagacaagactaaaacttccataaccagactgcaatcactcatcattgtttcttcagaagctgttttaaccacgtctaatgccattctccgcctccgggacactgaccttgtccctcagcttgttgaactctgccacggattaatgtacatgtggaagtcaatgcacgagtatcacgaaatccagaacaacatcgtgcaacaagtccgtggcctgatcaaccaaacagagagaggtgagtcaacatcagaggtacaccggcaggtgacgcgggacctagagtcagctgtgtccttgtggcattcgagcttctgtcgcatcattaaattccagagggagttcatatgctctctccacgcatggttcaagctgagcctggttcccctgagcaacggagacccaaagaaacagcggccagactcatttgccttgtgcgaggagtggaagcagagcctggaacgggtgcctgacacagtggcgtcagaagccataaagagctttgtaaacgtggtacatgtgatatcaataaagcaggcggaagaggtgaagatgaagaaacgcacggagagtgcaggaaaggagctggagaagaaagcatcctcactgaggagcatagagaggaagtactaccaggcatactcgacggttgggataggccctggaccggaggtgttggactcacgggacccgctatctgagaagaaatgtgagctggcggcatgtcagaggcaggtggaggatgaggtaatgaggcacgtgaaggctgtggaggtgacacgagctatgactctcaacaatctacaaaccggcctgcccaatgtattccaggccttgaccagcttctcatctctcttcactgaatctctccagactgtctgttctcgttcctactccatcaactgattatgtccaagtttctcatttatttttaagctctcattacgttggtatcatgtaaatttgaggattgattaaattgagtcttgtggttttgtgaggactcacaatctttctcatttaaaaaaaaaaaaaaaaaaa

SEQ ID NO: 2364 - protein, 703 aa, Arabidopsis thaliana
  G577
MGCTASKLDSEDAVRRCKERRRLMKDAVYARHHLAAAHSDYCRSLRLTGSALSSFAAGEPLSVSENTPAVFLRPSSSQDAPRVPSSHSPEPPPPPIRSKPKPTRPRRLPHILSDSSPSSSPATSFYPTAHQNSTYSRSPSQASSVWNWENFYPPSPPDSEYFERKARQNHKHRPPSDYDAETERSDHDYCHSRRDAAEEVHCSEWGDDHDRFTATSSSDGDGEVETHVSRSGIEEEPVKQPHQDPNGKEHSDHVTTSSDCYKTKLVVRHKNLKEILDAVQDYFDKAASAGDQVSAMLEIGRAELDRSFSKLRKTVYHSSSVFSNLSASWTSKPPLAVKYKLDASTLNDEQGGLKSLCSTLDRLLAWEKKLYEDVKAREGVKIEHEKKLSALQSQEYKGGDESKLDKTKTSITRLQSLIIVSSEAVLTTSNAILRLRDTDLVPQLVELCHGLMYMWKSMHEYHEIQNNIVQQVRGLINQTERGESTSEVHRQVTRDLESAVSLWHSSFCRIIKFQREFICSLHAWFKLSLVPLSNGDPKKQRPDSFALCEEWKQSLERVPDTVASEAIKSFVNVVHVISIKQAEEVKMKKRTESAGKELEKKASSLRSIERKYYQAYSTVGIGPGPEVLDSRDPLSEKKCELAACQRQVEDEVMRHVKAVEVTRAMTLNNLQTGLPNVFQALTSFSSLFTESLQTVCSRSYSIN

SEQ ID NO: 2365 - DNA, 1757 bp, Arabidopsis thaliana
  G588
atctgaagtgaaccaagctcaggttttgtcttctctttgatcattcctttctcagcaatataaattagagttatatcctttataaaggattttgctttttcaccaacaaaccctaaattcggtgtctcagcaagaatcacgtgattctcgttcctcttcctcacgaaacccatcatcttctatctcatttgagaaatgggtcaaaagttttgggagaatcaagaagatcgagcgatggttgaatccaccataggctctgaagcttgcgactttttcatctcaacagcttcagcttccaacactgccttgtccaagcttgtctcaccaccaagtgattccaatctccaacaagggttacgtcacgttgttgaaggatctgattgggattatgctcttttctggctagcgtccaacgttaatagctctgatggttgtgtcttgatctggggagatggtcattgccgtgtcaaaaagggtgcttcaggtgaggattactctcagcaagatgagatcaaaagacgtgtgcttcgcaagcttcacttgtcgttcgttggttcagatgaagatcatcgtttggtgaaatcaggagctcttactgatctcgacatgttttatctggcttctttgtacttttcctttaggtgtgataccaataagtacggtcctgctggaacctatgtgtctgggaagcctctttgggctgcagatttgcctagctgcttgagttattatagggttaggtctttcttagctaggtcagctggttttcagactgtgttgtctgtaccagtgaattctggagttgtggagcttggttctttaagacatattccagaagataagagtgtgattgagatggtgaaatcagtgtttggtgggtctgactttgttcaggctaaagaagctcctaaaatctttggtcgacagctgagtcttggtggagcaaaacctcggtctatgagtattaatttctccccgaagaccgaggatgacacgggtttctcattggaatcgtatgaggtgcaagcgatcggaggctctaatcaagtgtatggttatgagcaagggaaagatgagacattgtatctaactgacgagcaaaagccgaggaagagagggagaaaaccagcaaatggaagagaagaggctctaaaccatgtggaagcggaacggcagaggagggagaagctgaaccagagattctacgctttgagagcggtggtgcctaacatctccaagatggacaaggcttcgctccttgcagacgcaatcacttacatcacggatatgcagaagaaaatcagggtgtatgaaacagagaagcagataatgaagaggagggagagtaatcagataactccagcagaggttgattatcaacagaggcatgatgatgcagttgtaaggctaagctgtccgttggaaactcatccagtttcaaaggtgatacaaacgttgagggagaatgaagttatgcctcatgattccaacgtggccatcacagaggagggtgtggttcacacattcactctccggcctcagggtggctgcaccgctgagcagttgaaggacaagctccttgcctctctatcacagtaactatcacagcagtaactgctatgtaataagtgtaaccgtgttggaggttgtatcaatgtactattgcaagccaaccaaaaaaaactccagcttagtaggatcgtgtaattttccttatatgtaatgttgagatttgtcttttacatataaagatttga

SEQ ID NO: 2366 - protein, 467 aa, Arabidopsis thaliana
  G588
MGQKFWENQEDRAMVESTIGSEACDFFISTASASNTALSKLVSPPSDSNLQQGLRHVVEGSDWDYALFWLASNVNSSDGCVLIWGDGHCRVKKGASGEDYSQQDEIKRRVLRKLHLSFVGSDEDHRLVKSGALTDLDMFYLASLYFSFRCDTNKYGPAGTYVSGKPLWAADLPSCLSYYRVRSFLARSAGFQTVLSVPVNSGVVELGSLRHIPEDKSVIEMVKSVFGGSDFVQAKEAPKIFGRQLSLGGAKPRSMSINFSPKTEDDTGFSLESYEVQAIGGSNQVYGYEQGKDETLYLTDEQKPRKRGRKPANGREEALNHVEAERQRREKLNQRFYALRAVVPNISKMDKASLLADAITYITDMQKKIRVYETEKQIMKRRESNQITPAEVDYQQRHDDAVVRLSCPLETHPVSKVIQTLRENEVMPHDSNVAITEEGVVHTFTLRPQGGCTAEQLKDKLLASLSQ

SEQ ID NO: 2367 - DNA, 1240 bp, Arabidopsis thaliana
  G591
gtaaatctctctttgaaggttcctaactcgttaatcgtaactcacagtgactcgttcgagtcaaagtctctgtctttagctcaaaccatggctagtaacaaccctcacgacaacctttctgaccaaactccttctgatgatttcttcgagcaaatcctcggccttcctaacttctcagcctcttctgccgccggtttatctggagttgacggaggattaggtggtggagcaccgcctatgatgctgcagttgggttccggagaagaaggaagtcacatgggtggcttaggaggaagtggaccaactgggtttcacaatcagatgtttcctttggggttaagtcttgatcaagggaaaggacctgggtttcttagacctgaaggaggacatggaagtgggaaaagattctcagatgatgttgttgataatcgatgttcttctatgaaacctgttttccacgggcagcctatgcaacagccacctccatcggccccacatcagcctacttcaatccgtcccagggttcgagctaggcgtggtcaggctactgatccacatagcatcgctgagcggctacgtagagaaagaatagcagaacggatcagggcgctgcaggaacttgtacctactgtgaacaagaccgatagagctgctatgatcgatgagattgtcgattatgtaaagtttctcaggctccaagtcaaggttttgagcatgaaccgacttggtggagccggtgcggttgctccacttgttactgatatgcctctttcatcatcagttgaggatgaaacgggtgagggtggaaggactccgcaaccagcgtgggagaaatggtctaacgatgggactgaacgtcaagtggctaaactgatggaagagaacgttggagccgcgatgcagcttcttcaatcaaaggctctttgtatgatgccaatctcattggcaatggcaatttaccattctcaacctccggatacatcttcagtggtcaagcctgagaacaatcctccacagtaggatttctgcaataaagagtttgtacagctaatccaactgtccaacatgggtttttcttctgctctaatgactctggtttcttctctcctctctcaccgacttgaaaggtaaaaaagtgaaaaaggctttgtagatggaatcaatgtaggatttgcagtagagggcaaaaaaatgtcatatagctcaattgatcaagtcttaaaaaaaaaaaaaaaaaaaa

SEQ ID NO: 2368 - protein, 310 aa, Arabidopsis thaliana
  G591
MASNNPHDNLSDQTPSDDFFEQILGLPNFSASSAAGLSGVDGGLGGGAPPMMLQLGSGEEGSHMGGLGGSGPTGFHNQMFPLGLSLDQGKGPGFLRPEGGHGSGKRFSDDVVDNRCSSMKPVFHGQPMQQPPPSAPHQPTSIRPRVRARRGQATDPHSIAERLRRERIAERIRALQELVPTVNKTDRAAMIDEIVDYVKFLRLQVKVLSMNRLGGAGAVAPLVTDMPLSSSVEDETGEGGRTPQPAWEKWSNDGTERQVAKLMEENVGAAMQLLQSKALCMMPISLAMAIYHSQPPDTSSVVKPENNPPQ

SEQ ID NO: 2369 - DNA, 1394 bp, Arabidopsis thaliana; identical to SEQ ID NO: 2037
  G596

SEQ ID NO: 2370 - protein, 317 aa, Arabidopsis thaliana; identical to SEQ ID NO: 2038
  G596

SEQ ID NO: 2371 - DNA, 1857 bp, Arabidopsis thaliana
  G599
tcgacagaacagcttcgttgtcacttgtcattctataaatcgcatccccattgacaacctttcacttccatcaaaactctctctctatatctctctctctatatatctctctctatatctctctctctcttcactctctctttctttcaaaatggaaaaactcatggttccgacatggagacccgacccggtttaccgtccaccggaaacaccactcgaaccgatggagtttttagctcgttcatggagcgtctctgctctcgaagtctccaaggctctaacaccacccaaccctcagattctcctctccaaaaccgaagaagaagaagaagaagaacccatctcctctgtcgtagacggcgacggcgacacggaagacaccggacttgtcaccggaaacccattctccttcgcttgttcagaaacttctcaaatggtcatggatcgtatcttgtctcactctcaagaagtatcaccaagaacatctggtcggctatctcacagtagtggtccacttaatggttctttgaccgacagtcctcctgtgtctcctcccgaatccgacgacattaagcaattttgcagagcgaacaaaaattcattgaacagtgtaaattctcagttccgttcaacggcggcaactccgggacctataaccgctacagctacacagtccaagacggtgggacggtggcttaaggaccggagagagaaaaagaaagaggagactcgggctcataacgctcagattcacgctgctgtctctgtcgccggcgttgctgcagctgttgctgctattgcagcagccaccgctgcgtcttctagctgtggtaaggatgagcagatggctaaaactgacatggccgttgcttctgctgcgacccttgtggctgctcagtgtgtggaagctgctgaagttatgggagctgagagagagtatttggcttctgttgttagctccgccgtcaatgttcgttctgccggagatattatgactctcaccgccggagcagctacagctttaagaggagtgcaaacattgaaggcaagggcaatgaaggaagtgtggaacatagcatcagtgataccaatggataaaggactcacttctacaggaggaagcagcaataatgttaatggtagcaatggaagctcaagcagtagtcacagtggtgaacttgtacaacaggagaatttcttgggaacttgtagtagagaatggctcgctagaggttgtgaactcctcaaacgcactcgcaaaggtgatctccactggaagatagtatctgtttacatcaacaaaatgaatcaggttatgttgaagatgaagagcaggcatgttggaggaaccttcaccaagaagaaaaagaacattgtgcttgatgtgatcaagaatgtcccggcctggcctggacgacatttgctagagggaggagatgatctaagatacttcggtttgaagacggttatgcgaggtgatgttgaattcgaggtcaagagccaaagggaatatgaaatgtggacacaaggtgtctcaaggcttcttgttcttgctgctgagaggaagtttaggatgtgaataaacgttcaatggctgcttggtttaagtgtgagtttttttttaacttatgtggtcaaatttcattagtaggggttcttttaaggtaatggttttttgggttgggtataggataaaatggacctaccagtcaaggtgaggaagcatttgggtaaacaaaacttagtgggggtgatctgtaatatctatgttcttagtttttttttggttgttggtggtctttttgtataaaaaaacaaagttgaagtaatagatatatagtatgttttaattttaaa

SEQ ID NO: 2372 - protein, 475 aa, Arabidopsis thaliana
  G599
MEKLMVPTWRPDPVYRPPETPLEPMEFLARSWSVSALEVSKALTPPNPQILLSKTEEEEEEEPISSVVDGDGDTEDTGLVTGNPFSFACSETSQMVMDRILSHSQEVSPRTSGRLSHSSGPLNGSLTDSPPVSPPESDDIKQFCRANKNSLNSVNSQFRSTAATPGPITATATQSKTVGRWLKDRREKKKEETRAHNAQIHAAVSVAGVAAAVAAIAAATAASSSCGKDEQMAKTDMAVASAATLVAAQCVEAAEVMGAEREYLASVVSSAVNVRSAGDIMTLTAGAATALRGVQTLKARAMKEVWNIASVIPMDKGLTSTGGSSNNVNGSNGSSSSSHSGELVQQENFLGTCSREWLARGCELLKRTRKGDLHWKIVSVYINKMNQVMLKMKSRHVGGTFTKKKKNIVLDVIKNVPAWPGRHLLEGGDDLRYFGLKTVMRGDVEFEVKSQREYEMWTQGVSRLLVLAAERKFRM

SEQ ID NO: 2373 - DNA, 1519 bp, Arabidopsis thaliana
  G615
ttttttcttttctttctttttttgctggtgtgagaaattgtacgcttactatctctctctctctctgccagattctctctttttgatgatgtgaaagttgtgcttttgtttcttaagaaaaaggcatatttttaatacttgattcttggttcttgattcttgattcttggttttttttagcttcttaagttcggtgatgtcgtcttccaccaatgactacaacgatggtaataacaatggagtgtaccctctctctctttacctttcttcactctctggccatcaagacatcattcataatccctacaaccatcagttaaaagcatctccgggccatatggtatcagcagttcctgaatctctgatcgattacatggcgtttaagtcaaataatgttgtgaatcaacaaggctttgagtttcctgaggtgtcaaaggaaatcaagaaggtggtgaagaaggaccgacatagcaagattcaaacggcacaagggattagagacaggagggttaggctttttattgggattgctcgccaattctttgatcttcaggatatgttggggtttgataaagctagtaaaacgttagactggctgctcaagaagtcaagaaaagccatcaaagaggtcgtacaagcaaaaaacctcaacaatgatgatgaagattttggaaacattggaggcgatgtagaacaagaagaggagaaggaggaggatgacaatggcgataagagcttcgtgtatggtttgagccccgggtacggtgaagaagaagtggtatgtgaggccacgaaggcagggataagaaagaagaagagtgagttgagaaacatctcatcaaaggggctaggagccaaagctagaggaaaagcaaaggagcgaacaaaagagatgatggcctatgataatccagagactgcctctgatattacacaatctgaaatcatggacccattcaagaggtctatagtcttcaatgaaggagaagatatgacacaccttttctacaaggaaccaatcgaggagtttgataatcaagaatctatcttaaccaatatgactctaccaacgaagatgggtcaaagttacaatcaaaataatgggatacttatgttggtagatcagagttctagcagcaactataatacatttctgcctcaaaatttggattatagttatgatcaaaacccttttcatgaccaaaccttatatgtagtcaccgacaaaaatttccccaaaggtttcctataaatctcgacagttttgaaggactatgcatgatcaagtttaaacatgtaagccaatatagtcccttattcctctgaatgtatacaaaatctatagttatgtatatctgttcctttttaacgtatctttattgatcttctgtgccttgatcaaaattgtcattttaagattcagtttgtgtaatattttagctacaacttttaagtggtattattgtaaccttttgaactatatattttgaagatgaataagaacatgtttatataaaaa

SEQ ID NO: 2374 - protein, 351 aa, Arabidopsis thaliana
  G615
MSSSTNDYNDGNNNGVYPLSLYLSSLSGHQDIIHNPYNHQLKASPGHMVSAVPESLIDYMAFKSNNVVNQQGFEFPEVSKEIKKVVKKDRHSKIQTAQGIRDRRVRLFIGIARQFFDLQDMLGFDKASKTLDWLLKKSRKAIKEVVQAKNLNNDDEDFGNIGGDVEQEEEKEEDDNGDKSFVYGLSPGYGEEEVVCEATKAGIRKKKSELRNISSKGLGAKARGKAKERTKEMMAYDNPETASDITQSEIMDPFKRSIVFNEGEDMTHLFYKEPIEEFDNQESILTNMTLPTKMGQSYNQNNGILMLVDQSSSSNYNTFLPQNLDYSYDQNPFHDQTLYVVTDKNFPKGFL

SEQ ID NO: 2375 - DNA, 1431 bp, Arabidopsis thaliana
  G616
ctttaaatcccaaaccaaccctaaagttttgatttttaattttgggggtaaccaaaaaaaaaacaaaaccctaattttttttctttagtgatgagattattggtgatgatgaaatgattggagatctaatgaagaataacaacaatggcgacgttgtggataacgaagtgaacaaccggttaagccggtggcatcacaattcttcccggataattagggtttcacgagcttccggtggtaaagatcgacacagcaaagtcttgacttctaaaggaccacgtgaccgtcgtgtccggttatcagtctccaccgctcttcaattctatgatcttcaagatcggttaggttatgatcaacctagcaaagctgttgaatggttaatcaaagctgctgaagattcaatctctgagcttccttcactcaacaacactcattttccgaccgatgacgagaatcaccagaatcagacattaacaacagttgctgctaattccttgtctaaatctgcttgtagtagcaattcagacacgagcaagaactcttctggtttgtctttatcaagatcggagcttagagataaagctagagagagggctagagagagaacagctaaagagaccaaggaaagagatcataaccacacttcgtttacggatttgttaaattccggttcagatccggttaactcaaaccggcaatggatggcttcagctccttcttcatctccaatggagtatttcagttcgggtttaattctcgggtcgggtcaacaaacccatttccctatttcaacaaattctcatcctttctcatcaatctccgatcatcatcatcatcatcctcatcatcagcatcaagagttttcattcgttcccgaccatttgatatcaccggcagaatccaacggcggagcattcaatcttgattttaatatgtcaacaccctccggcgccggagctgccgtctccgccgcatcaggtggtggcttcagtggtttcaacagggggacccttcagtccaattcaacaaatcagcatcagtcattcctcgctaatctacagaggtttccaacatcagaaagtggaggaggtccacagttcttattcggtgcactgcctgcagagaatcaccaccacaatcaccagtttcagctttactatgaaaatggatgcagaaactcatcagaacataagggtaaaggcaagaactgatgatattaattattgcatctttggttttgttcaaatgctcattttgtatgtttatctttggtttatttcaaaacaaatgttaatctctttcgttgtctgatgtgtgttagggttttgttttatgtattgagggtctttggaaatctttttgcattgtgcttgtaatgttgtatttgtgataatagcattttgtttgtgagttaaaaaaaaaaaaaaaaaa

SEQ ID NO: 2376 - protein, 360 aa, Arabidopsis thaliana
  G616
MKNNNNGDVVDNEVNNRLSRWHHNSSRIIRVSRASGGKDRHSKVLTSKGPRDRRVRLSVSTALQFYDLQDRLGYDQPSKAVEWLIKAAEDSISELPSLNNTHFPTDDENHQNQTLTTVAANSLSKSACSSNSDTSKNSSGLSLSRSELRDKARERARERTAKETKERDHNHTSFTDLLNSGSDPVNSNRQWMASAPSSSPMEYFSSGLILGSGQQTHFPISTNSHPFSSISDHHHHHPHHQHQEFSFVPDHLISPAESNGGAFNLDFNMSTPSGAGAAVSAASGGGFSGFNRGTLQSNSTNQHQSFLANLQRFPTSESGGGPQFLFGALPAENHHHNHQFQLYYENGCRNSSEHKGKGKN

SEQ ID NO: 2377 - DNA, 1242 bp, Arabidopsis thaliana
  G617
cagatctgttctttacaccaaattgagtactgaagatcttgttgagtgaattaaagagatgagatcaggagaatgtgatgaagaggagattcaagcaaagcaagaaagagatcaaaatcaaaatcatcaagtaaacttaaaccacatgttgcaacaacaacagccgagttcggtatcatcttcaaggcaatggacttcagcttttaggaatccaagaatcgttcgagtctcaagaacattcggtggcaaagacagacacagcaaagtatgtacagtccgtggtcttcgagaccggaggataaggttgtccgtacctacagctattcaactctacgaccttcaagatcgattagggctgagtcagccaagcaaagtcattgattggttactcgaagcagcaaaagatgacgtagacaagctacctcctctacaattcccacatggatttaaccagatgtatccaaatctcatcttcggaaactccgggtttggagaatctccatcttcaactacatcaacaacgtttccaggaaccaatctcgggttcttggaaaattgggatcttggtggttcttcaagaacaagagcaagattaaccgatacaactacgacccaaagagaaagttttgatcttgataaaggaaaatggatcaaaaacgacgagaatagtaatcaagatcatcaagggtttaacaccaatcatcaacaacaatttcctctgaccaatccgtacaacaacacttcagcttattacaaccttggacatcttcaacaatcgttagaccaatctggtaataacgttactgtcgcaatatctaatgttgctgctaataataacaataatctcaatttgcatcctccttcctcgtctgccggagatggatctcagctttttttcggtcctactcctccggcaatgagctctctattcccgacatacccttcgtttcttggagcttctcatcatcatcatgtcgtcgatggagccggtcatcttcagctctttagctcgaattcaaataccgcatcgcagcaacacatgatgccgggtaatacgagtttgattagaccatttcatcatttgatgagctcgaatcatgatacggatcatcatagtagcgataatgaatcagattcttgaatgattttatatatctacactatacattgaaaatgttatatgtatacgtattcttctatattttgatatatatgcgtattgttggattggtttatgtatct

SEQ ID NO: 2378 - protein, 360 aa, Arabidopsis thaliana
  G617
MRSGECDEEEIQAKQERDQNQNHQVNLNHMLQQQQPSSVSSSRQWTSAFRNPRIVRVSRTFGGKDRHSKVCTVRGLRDRRIRLSVPTAIQLYDLQDRLGLSQPSKVIDWLLEAAKDDVDKLPPLQFPHGFNQMYPNLIFGNSGFGESPSSTTSTTFPGTNLGFLENWDLGGSSRTRARLTDTTTTQRESFDLDKGKWIKNDENSNQDHQGFNTNHQQQFPLTNPYNNTSAYYNLGHLQQSLDQSGNNVTVAISNVAANNNNNLNLHPPSSSAGDGSQLFFGPTPPAMSSLFPTYPSFLGASHHHHVVDGAGHLQLFSSNSNTASQQHMMPGNTSLIRPFHHLMSSNHDTDHHSSDNESDS

SEQ ID NO: 2379 - DNA, 3001 bp, Arabidopsis thaliana
  G619
atttttttccaatctgcaaattttagtctatgtctgttccttgtgctccctcttctcagtacctgcaaatggaggaagaagaatccttctctgaaacccttgttctcatttgattcctccttcctctctcttcttctctctctgtctctgattcgttattccacacttatgactcatctttcccgtcaatagctaagtttgcctcttctttgtgaaatttagctgaaaaaggagaggaattccgaattctgtcacttcaaagctcgaattttgcaaactttcctttgatgggttttacttgttttgttgtaatctgattaaaaatagaaactttttgttttcttcttgtctccttttgctcttaaaagagaagctttttcaatggaatttgacttgaatactgagattgcggaggtggaagaggaggagaatgatgatgtaggagtaggagtaggaggaggaacaagaattgacaagggtaggcttggaatttcaccatcttcttcttcttcatgctcttccggatcatcatcgtcatcatcttctacaggctctgcatcttccatttactctgagctttggcatgcttgtgctggtcctctcacttgtcttcccaagaaaggcaatgtagttgtctatttccctcaaggtcatttggagcaagatgctatggtttcatattcgtctcctcttgaaatccccaaatttgaccttaatccccaaatcgtctgcagggtggttaatgtccagttgcttgctaataaggacaccgatgaggtctacactcaagtcactctgcttccacttcaagagttttcgatgctaaatggggaggggaaagaggtcaaggagttaggaggggaggaagagaggaacggaagctcatccgtcaagcggacacctcatatgttctgtaaaaccttaacagcgtctgacacaagcacacatggaggcttctctgtacctagaagagccgctgaagattgttttgctcctcttgactacaaacaacagaggccatctcaagagctcattgcaaaggacctccatggagtagagtggaagtttcgccatatctatagaggtcaaccaaggaggcatctactcaccactggttggagtatctttgtcagtcaaaagaatctcgtctctggtgatgcggttctctttctgagagacgaaggaggagagctgagattaggaatcagaagagcagcacggccaagaaatggacttcctgactcaatcattgagaagaattcatgttcaaacattctgtctcttgtggctaatgctgtatctacaaaaagcatgtttcatgtgttctacagtccacgagcgacgcatgcagagtttgtgattccttatgagaagtatatcacaagcatcaggagtcctgtttgcataggcacaagatttagaatgcgatttgaaatggacgattctcctgagagaagatgcgctggtgtagtgactggagtctgtgacttggacccgtataggtggccaaactctaaatggaggtgcttgttggtgcgatgggatgagtcttttgtgagtgatcatcaagaaagagtttcaccttgggagattgatccctcggtttctctcccacacttgagcattcagtcatctccaaggcctaaaaggccatgggcaggtttactggatactaccccacccggaaaccccataacaaaaaggggtggttttttggactttgaggagtcggttagaccctctaaggtcttgcaaggtcaagaaaatataggttctgcatcaccctcacaggggtttgatgttatgaaccgccggatactggattttgcgatgcagtctcatgcaaatccagtccttgtgtcgagtagagtcaaggatcgatttggtgagtttgtagatgctactggcgtgaacccagcttgttcaggtgttatggacctggataggtttccaagggtcttgcaaggtcaagaaatttgctcgcttaaatcattcccgcaatttgctggtttcagtccagctgctgctcctaatccctttgcttaccaagccaacaagtcaagttactatccgctagctttgcatgggattaggagcactcatgttccgtatcagaatccatacaatgcgggaaaccaatcctcgggtcccccttcacgtgcaataaactttggtgaagagactagaaagtttgatgcacaaaatgaaggtggcctaccaaataatgttacagctgatttgccattcaagattgatatgatgggaaaacagaaaggcagtgagttgaatatgaatgcttcatcaggatgtaaacttttcggattctccttaccagtggagacacctgcatctaagccgcaaagctcgagcaaaagaatctgtacaaaggttcacaagcaaggaagccaagtggggagagctattgatttgtcgcgacttaacgggtatgatgatctccttatggagcttgaacggctgttcaacatggaagggcttctcagggatcctgaaaaaggatggaggatcttatatactgatagtgagaacgatatgatggtcgttggcgatgatccatggcatgatttctgcaatgtggtgtggaagatacacttatacacgaaagaggaagtggagaatgcgaatgacgataacaagagttgtttagagcaagctgctctcatgatggaagcatcaaagtcatcttctgtgagccagcctgattcttctcctacaatcactagggtttgatacccataaagaagcttatttcctatgttttaaagtgtgttttgctcacaaaagaacttcaactttatctttgtctttgaatccatttatgtgtttgtttgtgtttcttctggtctccatggatgtctcatgtgtaccgttttactcgagagatatgtgagtttatgggatgtgtaaagcatgccattggattttaaggttttcaaaattacaatatatatattagttttgaagttaaaaaaaaaaaaaaaaa

SEQ ID NO: 2380 - protein, 788 aa, Arabidopsis thaliana
  G619
MEFDLNTEIAEVEEEENDDVGVGVGGGTRIDKGRLGISPSSSSSCSSGSSSSSSSTGSASSIYSELWHACAGPLTCLPKKGNVVVYFPQGHLEQDAMVSYSSPLEIPKFDLNPQIVCRVVNVQLLANKDTDEVYTQVTLLPLQEFSMLNGEGKEVKELGGEEERNGSSSVKRTPHMFCKTLTASDTSTHGGFSVPRRAAEDCFAPLDYKQQRPSQELIAKDLHGVEWKFRHIYRGQPRRHLLTTGWSIFVSQKNLVSGDAVLFLRDEGGELRLGIRRAARPRNGLPDSIIEKNSCSNILSLVANAVSTKSMFHVFYSPRATHAEFVIPYEKYITSIRSPVCIGTRFRMRFEMDDSPERRCAGVVTGVCDLDPYRWPNSKWRCLLVRWDESFVSDHQERVSPWEIDPSVSLPHLSIQSSPRPKRPWAGLLDTTPPGNPITKRGGFLDFEESVRPSKVLQGQENIGSASPSQGFDVMNRRILDFAMQSHANPVLVSSRVKDRFGEFVDATGVNPACSGVMDLDRFPRVLQGQEICSLKSFPQFAGFSPAAAPNPFAYQANKSSYYPLALHGIRSTHVPYQNPYNAGNQSSGPPSRAINFGEETRKFDAQNEGGLPNNVTADLPFKIDMMGKQKGSELNMNASSGCKLFGFSLPVETPASKPQSSSKRICTKVHKQGSQVGRAIDLSRLNGYDDLLMELERLFNMEGLLRDPEKGWRILYTDSENDMMVVGDDPWHDFCNVVWKIHLYTKEEVENANDDNKSCLEQAALMMEASKSSSVSQPDSSPTITRV

SEQ ID NO: 2381 - DNA, 826 bp, Arabidopsis thaliana
  G620
gaattgaacttggaccagcacagcaacaacccaaccccaatgaccagctcagtcatagtagccggcgccggtgacaagaacaatggtatcgtggtccagcagcaaccaccatgtgtggctcgtgagcaagaccaatacatgccaatcgcaaacgtcataagaatcatgcgtaaaaccttaccgtctcacgccaaaatctctgacgacgccaaagaaacgattcaagaatgtgtctccgagtacatcagcttcgtgaccggtgaagccaacgagcgttgccaacgtgagcaacgtaagaccataactgctgaagatatcctttgggctatgagcaagcttgggttcgataactacgtggaccccctcaccgtgttcattaaccggtaccgtgagatagagaccgatcgtggttctgcacttagaggtgagccaccgtcgttgagacaaacctatggaggaaatggtattgggtttcacggcccatctcatggcctacctcctccgggtccttatggttatggtatgttggaccaatccatggttatgggaggtggtcggtactaccaaaacgggtcgtcgggtcaagatgaatccagtgttggtggtggctcttcgtcttccattaacggaatgccggcttttgaccattatggtcagtataagtgaagaaggagttattcttcatttttatatctattcaaaacatgtgtttcgatagatattttatttttatgtcttatcaataacatttctatataatgttgcttctttaaggaaaagtgttgtatgtcaatactttatgagaaactgatttatatatgcaaat

SEQ ID NO: 2382 - protein, 208 aa, Arabidopsis thaliana
  G620
MTSSVIVAGAGDKNNGIVVQQQPPCVAREQDQYMPIANVIRIMRKTLPSHAKISDDAKETIQECVSEYISFVTGEANERCQREQRKTITAEDILWAMSKLGFDNYVDPLTVFINRYREIETDRGSALRGEPPSLRQTYGGNGIGFHGPSHGLPPPGPYGYGMLDQSMVMGGGRYYQNGSSGQDESSVGGGSSSSINGMPAFDHYGQYK

SEQ ID NO: 2383 - DNA, 2628 bp, Arabidopsis thaliana
  G622
tctttctttcttcaattcgccgtcaaaatcttctctttctcttcccccgccggtccttcaccaatcctctgatctctctacacacgaacctttgattttgaccaacgtcgatgcatgttcatgactagtctcttcctcaatccttcaatttcatcaattcacgtcgatttcgtatccgattcgttgttctagctctttgtgtggtgttagggttttaagattttggaattggggtttggagtttgtgatgtttgaagtcaaaatggggtcaaagatgtgcatgaacgcttcatgtggtacgacttctactgttgaatggaagaaaggttggcctcttcgatctggtcttctcgctgatctctgttatcgttgcggatctgcgtatgagagttctctattctgtgaacaatttcataaggaccaatctggttggagggaatgctatttgtgtagcaagagactacattgtggatgcattgcttctaaggtaacgattgagttaatggactatggtggtgttggttgtagtacatgtgcttgctgccatcaactcaatttgaacacaaggggtgagaatccaggtgtttttagcagattgccaatgaaaacgttagctgataggcaacatgtaaatggcgaaagcggaggaagaaacgaaggcgatctcttttctcagccactagtcatgggcggagataaaagggaagagttcatgcctcaccgtgggtttggtaagctaatgagtccagaaagtacaaccaccgggcataggctggatgctgctggggaaatgcatgaatcatcacctttacagccatctttaaatatgggtttggctgtgaatccgtttagcccatcttttgcaaccgaggctgtcgagggaatgaaacacatcagtccttctcagtccaacatggtccattgctctgcttctaatatactgcaaaagccatcaagacctgctatttcaactcctcctgtggctagtaaatccgctcaggcgcggattggaaggcctcctgtcgaagggcgagggagaggccacttgcttccgcggtattggccaaaatatacggataaagaggttcagcagatctctggaaatttgaatttgaacattgtacctctctttgagaaaactcttagtgccagtgatgctggtcgcattggtcgtctagttcttccaaaagcctgtgcagaggcatattttcctccgattagtcaatccgaaggcattcctttgaaaatccaagatgtgaggggtagggagtggacgttccagttcagatattggcccaataacaatagtagaatgtatgttttagaaggtgtcactccatgcatacagtccatgatgctacaggctggtgatacagtaactttcagtcgggttgatcctggcggaaaactaatcatgggttccaggaaggcagctaatgctggagacatgcagggttgtgggctcaccaacggaacatcaactgaggacacatcatcgtctggtgtaacagaaaacccaccctccataaatggttcctcgtgtatttcactaataccgaaagagttgaatggtatgcctgagaatttgaacagtgagactaacgggggcaggataggtgatgatcctacacgagttaaagagaagaagagaactcgaaccattggtgcaaaaaataagagacttcttttgcatagtgaagaatctatggagctgagactcacttgggaagaagctcaggacttgcttcgtccctctcctagtgtaaagcctaccatcgttgtcattgaggagcaagaaattgaagaatatgacgaacctcctgtctttggaaagaggactatagtcactacaaaaccttcaggtgaacaggaacgatgggcaacttgcgacgactgctctaaatggagaaggttacctgtagatgctcttctttcctttaaatggacatgtatagacaatgtttgggatgtgagtaggtgttcatgttctgcaccggaggagagtctgaaggaacttgagaatgttcttaaagtaggtagagagcacaagaagagaagaactggggaaagacaggcagcacaaagtcagcaagaaccgtgtggtttggacgcactggcgagtgcagcagtcttaggagacacaataggcgagccagaggtagcgaccacgaccagacatccaaggcacagggctggatgctcttgcatcgtgtgcattcagccaccaagtgggaaaggtaggcacaagcctacatgtggctgcactgtgtgtagcaccgtgaagagaaggttcaagacgcttatgatgaggaggaagaagaagcagttggagcgcgatgtaacagcagcagaagataagaagaagaaggacatggaactggctgagtctgataagagtaaggaggagaaggaagtgaacacagcgagaatagacctgaacagtgatccatacaataaagaagatgttgaagctgttgcggtggagaaagaagagagtcgaaaaagagcaataggacagtgttcgggcgtggtggctcaagacgccagtgatgttttaggagttacagagttagaaggagagggtaagaatgttcgtgaagagccgagagtttcaagctgatatggaaa

SEQ ID NO: 2384 - protein, 790 aa, Arabidopsis thaliana
  G622
MFEVKMGSKMCMNASCGTTSTVEWKKGWPLRSGLLADLCYRCGSAYESSLFCEQFHKDQSGWRECYLCSKRLHCGCIASKVTIELMDYGGVGCSTCACCHQLNLNTRGENPGVFSRLPMKTLADRQHVNGESGGRNEGDLFSQPLVMGGDKREEFMPHRGFGKLMSPESTTTGHRLDAAGEMHESSPLQPSLNMGLAVNPFSPSFATEAVEGMKHISPSQSNMVHCSASNILQKPSRPAISTPPVASKSAQARIGRPPVEGRGRGHLLPRYWPKYTDKEVQQISGNLNLNIVPLFEKTLSASDAGRIGRLVLPKACAEAYFPPISQSEGIPLKIQDVRGREWTFQFRYWPNNNSRMYVLEGVTPCIQSMMLQAGDTVTFSRVDPGGKLIMGSRKAANAGDMQGCGLTNGTSTEDTSSSGVTENPPSINGSSCISLIPKELNGMPENLNSETNGGRIGDDPTRVKEKKRTRTIGAKNKRLLLHSEESMELRLTWEEAQDLLRPSPSVKPTIVVIEEQEIEEYDEPPVFGKRTIVTTKPSGEQERWATCDDCSKWRRLPVDALLSFKWTCIDNVWDVSRCSCSAPEESLKELENVLKVGREHKKRRTGERQAAQSQQEPCGLDALASAAVLGDTIGEPEVATTTRHPRHRAGCSCIVCIQPPSGKGRHKPTCGCTVCSTVKRRFKTLMMRRKKKQLERDVTAAEDKKKKDMELAESDKSKEEKEVNTARIDLNSDPYNKEDVEAVAVEKEESRKRAIGQCSGVVAQDASDVLGVTELEGEGKNVREEPRVSS

SEQ ID NO: 2385 - DNA, 1500 bp, Arabidopsis thaliana
  G625
aatcgaccattcacaacgatgacattcaaacactcttcagtttcccttccttcttgattcgtcctctccactatttttctcaatttctttaatctctctctttctctctctacttcctcttcctcttcttcttcttcttcttcttcatctatggaccctttagcttcccaacatcaacacaaccatctggaagataataaccaaaccctaacccataataatcctcaatccgattccaccaccgactcatcaacttcctccgctcaacgcaaacgcaaaggcaaaggtggtccggacaactccaagttccgttaccgtggcgttcgacaaagaagctggggcaaatgggtcgccgagatccgagagccacgtaagcgcactcgcaagtggcttggtactttcgcaaccgccgaagacgccgcacgtgcctacgaccgggctgccgtttacctatacgggtcacgtgctcagctcaacttaaccccttcgtctccttcctccgtctcttcctcttcctcctccgtctccgccgcttcttctccttccacctcctcttcctccactcaaaccctaagacctctcctccctcgccccgccgccgccaccgtaggaggaggagccaactttggtccgtacggtatcccttttaacaacaacatcttccttaatggtgggacctctatgttatgccctagttatggttttttccctcaacaacaacaacaacaaaatcagatggtccagatgggacaattccaacaccaacagtatcagaatcttcattctaatactaacaataacaagatttctgacatcgagctcactgatgttccggtaactaattcgacttcgtttcatcatgaggtggcgttagggcaggaacaaggaggaagtgggtgtaataataatagttcgatggaggatttgaactctctagctggttcggtgggttcgagtctatcaataactcatccaccgccgttggttgatccggtatgttctatgggtctggatccgggttatatggttggagatggatcttcgaccatttggccttttggaggagaagaagaatatagtcataattgggggagtatttgggattttattgatcccatcttgggggaattctattaatttgtttttgtggaagatcatattatatacgatgagcatccctaaggtcggtcaagagcattggagattcattgttgagaggaatcaaagagattgcattctatgaggagctctgcatgcaaaattttggaggatttttttactacctatagagataaataagagggtatttttattatttttttgaagatttttattttcaaggaattcgtaaaagagattacggttccaataaagtatgtatatgtggaagagaatcggaggagatggtggaaagttgtatgggaattttattggttcaacacttccttcacagtgtgcctaccttaatatataattattgataggatatgataatttctg

SEQ ID NO: 2386 - protein, 328 aa, Arabidopsis thaliana
  G625
MDPLASQHQHNHLEDNNQTLTHNNPQSDSTTDSSTSSAQRKRKGKGGPDNSKFRYRGVRQRSWGKWVAEIREPRKRTRKWLGTFATAEDAARAYDRAAVYLYGSRAQLNLTPSSPSSVSSSSSSVSAASSPSTSSSSTQTLRPLLPRPAAATVGGGANFGPYGIPFNNNIFLNGGTSMLCPSYGFFPQQQQQQNQMVQMGQFQHQQYQNLHSNTNNNKISDIELTDVPVTNSTSFHHEVALGQEQGGSGCNNNSSMEDLNSLAGSVGSSLSITHPPPLVDPVCSMGLDPGYMVGDGSSTIWPFGGEEEYSHNWGSIWDFIDPILGEFY

SEQ ID NO: 2387 - DNA, 1661 bp, Arabidopsis thaliana
  G631
cttcttcttcttcttcttcttcttcttcctcctctctcgtcggatctctctgatttagtgatttttcaaatttcaagttttcttcacctttaattttgtgtctcgttgatctctctttggacattctgctttggattctggaggcttctcattagatctctattagtgggtttaggtcaagttcttgaaatggataaggagaaatctcctgcaccaccacctagtggaggtcttcctccaccatcgggtcgttactctgcgttttcacctaatggaagtagctttgcaatgaaagctgaatcatcttttcctcctttgactccaagtggaagcaatagctcagatgctaaccgattcagccatgatattagccgaatgccggataatccacctaagaacctaggccatcgccgagctcattcagagattcttactcttcctgatgacttaagctttgatagtgatcttggtgtggttggtgctgctgatggaccttctttctctgatgatactgacgaggacttactctatatgtatcttgatatggaaaaattcaattcttctgctacatcgacttctcaaatgggtgagccatcagaaccgacttggaggaatgaattagcctcgacttctaaccttcagagtacacccggtagctctagtgaaagaccgagaattagacaccaacacagccaatcgatggatggttcaacaactatcaagcctgagatgcttatgtcagggaatgaagatgtgtctggagttgactctaagaaagccatctctgctgctaaactttctgagcttgctctcattgatccaaaacgcgccaagaggatatgggcaaacaggcagtctgctgcgaggtcaaaagaaaggaagatgagatacattgcagagctcgagagaaaagtacagactttacaaacagaggccacatctctctcagcccagttgactctcttacagagagatacaaatggcctgggtgttgaaaacaatgagcttaaactgcgagtacaaactatggagcaacaggtccacctacaggatgctttaaatgatgcactaaaggaggaagtccagcatcttaaggtattgacggggcaaggtccatcaaatggtacatcaatgaactacggttcttttggatcaaaccagcaattctatcccaataatcagtcgatgcacactatcttagccgcacaacagttacagcagctccagatccagtcacagaaacagcaacaacaacaacagcaacaccagcaacaacaacagcagcagcagcagcaatttcactttcaacagcagcaactgtaccagcttcagcagcagcaacggcttcaacaacaggaacaacaaagcggggcttcagagctaagaagacccatgccttctcctggtcagaaagagagtgtgacatcgcctgatcgtgaaactcccttgacaaaagactgagtctagactgtgctaatgtccaatttagtaagttactcttggaaaatcttctttttcatcgcaggctcatggatttgggatttactgcattatagagttaaaaacaagacagcttagaagttgcggatttagaagttgttagtgaagcttttgttctcgtctgttggtagtttacaatcttctctttgtatgatcctaag

SEQ ID NO: 2388 - protein, 423 aa, Arabidopsis thaliana
  G631
MDKEKSPAPPPSGGLPPPSGRYSAFSPNGSSFAMKAESSFPPLTPSGSNSSDANRFSHDISRMPDNPPKNLGHRRAHSEILTLPDDLSFDSDLGVVGAADGPSFSDDTDEDLLYMYLDMEKFNSSATSTSQMGEPSEPTWRNELASTSNLQSTPGSSSERPRIRHQHSQSMDGSTTIKPEMLMSGNEDVSGVDSKKAISAAKLSELALIDPKRAKRIWANRQSAARSKERKMRYIAELERKVQTLQTEATSLSAQLTLLQRDTNGLGVENNELKLRVQTMEQQVHLQDALNDALKEEVQHLKVLTGQGPSNGTSMNYGSFGSNQQFYPNNQSMHTILAAQQLQQLQIQSQKQQQQQQQHQQQQQQQQQQFHFQQQQLYQLQQQQRLQQQEQQSGASELRRPMPSPGQKESVTSPDRETPLTKD

SEQ ID NO: 2389 - DNA, 948 bp, Arabidopsis thaliana
  G647
atgatgatcggcgaaaataaaaaccggccacatccaacgatccatatccctcaatgggatcaaatcaacgatccaacggccacaatctcttcaccattctcttccgtcaaccttaacagcgttaacgactacccacactctccgtcaccgtatctcgactccttcgcttctctcttccgttacctcccgtcaaacgagttaacaaacgattcagactcatcaagtggcgacgagtcatcaccactcaccgactcattctcctccgacgagtttcgcatctacgagttcaaaatccggcgatgcgctcgaggtcgatctcatgattggacggagtgtccgttcgcacatcccggagaaaaagctcgacgacgtgatccgagaaagtttcattactccggcaccgcttgtcctgagtttcgtaaaggaagttgtagaagaggtgattcgtgtgagttctctcatggagttttcgagtgttggctccatccttctcgttaccgtactcagccgtgtaaagacggaactagctgccggagaagaatctgtttcttcgctcatacgacggagcagttacgtgtattaccttgttcgttagatccagatcttggattcttctcaggattagctacttctccgacttcgattcttgtttctccttcgttttcaccaccgtcggaatctccgccgctttctccgagtaccggtgaacttattgcgtcgatgaggaaaatgcaattgaacggaggtggttgttcgtggagttctccgatgagatctgcagttaggttacctttttcgtcgtctctgcgtccgattcaggcggcaacgtggccgaggataagagagtttgagatcgaagaagctccggcgatggaatttgtggaatctgggaaagagctgagagcggagatgtatgcaagactcagtagagagaactcactcggttga

SEQ ID NO: 2390 - protein, 315 aa, Arabidopsis thaliana
  G647
MMIGENKNRPHPTIHIPQWDQINDPTATISSPFSSVNLNSVNDYPHSPSPYLDSFASLFRYLPSNELTNDSDSSSGDESSPLTDSFSSDEFRIYEFKIRRCARGRSHDWTECPFAHPGEKARRRDPRKFHYSGTACPEFRKGSCRRGDSCEFSHGVFECWLHPSRYRTQPCKDGTSCRRRICFFAHTTEQLRVLPCSLDPDLGFFSGLATSPTSILVSPSFSPPSESPPLSPSTGELIASMRKMQLNGGGCSWSSPMRSAVRLPFSSSLRPIQAATWPRIREFEIEEAPAMEFVESGKELRAEMYARLSRENSLG

SEQ ID NO: 2391 - DNA, 2331 bp, Arabidopsis thaliana
  G657
atgaagcgtgagatgaaagcacctactactccactagagagtctccaaggtgacctcaaaggaaaacaagggaggacatctggccctgctagacgatctaccaaaggacaatggacacctgaagaggacgaagtcttgtgtaaagctgttgagcgttttcaaggaaagaactggaagaagatagctgaatgttttaaggatcggactgatgttcagtgtcttcatagatggcaaaaggtcttgaacccagagcttgtgaaaggaccgtggtcaaaagaggaggataacacaataattgacctggttgaaaaatatgggccaaagaaatggtctactatatctcagcatttacctgggcgcataggaaagcaatgtagggaaaggtggcataaccatcttaaccctgggattaataaaaatgcatggactcaggaagaggaactgactcttattcgtgcgcatcaaatttatgggaataaatgggcagagcttatgaaatttttgccaggaaggtcagataattcgataaaaaatcattggaacagctcagttaagaagaagttggattcctactatgcatcaggtcttttagatcagtgtcaaagctcgccattaattgcccttcagaacaaatctatcgcttcatcttcctcgtggatgcacagcaatggagatgaaggtagttcaaggccaggggttgatgctgaggaatcagaatgcagccaagcttcaactgttttctcacaatcaaccaacgatttacaagatgaagttcaacgtggaaatgaggaatattacatgcctgaatttcattcaggaacggagcagcaaatctcaaacgctgcatctcatgcagaaccgtactacccttcctttaaagatgtcaaaattgttgtccccgaaatttcttgtgaaacagaatgttcgaagaagtttcagaatcttaattgttctcacgagctaagaactaccacagctacggaggatcaattgccgggtgtatctaatgatgctaaacaggaccgtggtctagagttattgacccataacatggacaacggtggaaaaaaccaagcacttcaacaagattttcaaagttcagtaagattaagtgatcaaccttttttgtcaaactcggacacagatccagaagctcaaactttgatcacggatgaggagtgttgtagggttctttttccagataacatgaaagatagcagtacatcttctggtgagcaaggtcggaatatggttgaccctcaaaacggcaaaggatctctttgttctcaggctgcagaaacccatgctcatgaaactggaaaagttccagctttaccgtggcatccttcaagttctgagggcctggcgggtcataattgtgtccctttgttggattcagacttgaaggactcacttttaccccgtaatgattccaacgctcctatacaaggttgtcgcctttttggagctaccgaattagaatgtaagactgatacaaatgacggtttcatcgatacttacggacatgtaacttcccatggcaatgatgataatggtggtttcccagaacaacaggggctgtcatatattcccaaggattctttgaagctagtacctttgaatagtttttcttctccttctagagtgaacaagatttattttcctattgacgataagccggctgaaaaagacaaaggagctctttgttatgaacctccacgttttccaagtgcagatattcctttcttcagctgtgatcttgtaccatcaaatagtgacttacggcaagagtacagtccctttggtatccgtcagttgatgatttcttcaatgaattgtacaactccgttaaggttatgggattcaccgtgtcacgataggagccctgatgtcatgcttaatgatactgccaaaagttttagtggtgcaccatccatcttaaagaagcggcatcgagacttgctttcacctgtgcttgatagaagaaaagacaaaaagcttaaaagggctgcgacttcctccttggctaatgatttttcgcgcttagatgtaatgcttgatgaaggagatgattgcatgacctctcgtccgtcagagtctcctgaagataaaaatatatgtgcctccccttccatagccagagataacagaaattgtgcatcagctcggttatatcaagaaatgattccgatagatgaggaaccaaaggaaaccttagaatcaggtggagtgacttctatgcaaaatgaaaatggatgtaatgacggtggtgcttcagctaaaaatgtaagtccgtctttgtccttgcatattatctggtatcagttataa

SEQ ID NO: 2392 - protein, 776 aa, Arabidopsis thaliana
  G657
MKREMKAPTTPLESLQGDLKGKQGRTSGPARRSTKGQWTPEEDEVLCKAVERFQGKNWKKIAECFKDRTDVQCLHRWQKVLNPELVKGPWSKEEDNTIIDLVEKYGPKKWSTISQHLPGRIGKQCRERWHNHLNPGINKNAWTQEEELTLIRAHQIYGNKWAELMKFLPGRSDNSIKNHWNSSVKKKLDSYYASGLLDQCQSSPLIALQNKSIASSSSWMHSNGDEGSSRPGVDAEESECSQASTVFSQSTNDLQDEVQRGNEEYYMPEFHSGTEQQISNAASHAEPYYPSFKDVKIVVPEISCETECSKKFQNLNCSHELRTTTATEDQLPGVSNDAKQDRGLELLTHNMDNGGKNQALQQDFQSSVRLSDQPFLSNSDTDPEAQTLITDEECCRVLFPDNMKDSSTSSGEQGRNMVDPQNGKGSLCSQAAETHAHETGKVPALPWHPSSSEGLAGHNCVPLLDSDLKDSLLPRNDSNAPIQGCRLFGATELECKTDTNDGFIDTYGHVTSHGNDDNGGFPEQQGLSYIPKDSLKLVPLNSFSSPSRVNKIYFPIDDKPAEKDKGALCYEPPRFPSADIPFFSCDLVPSNSDLRQEYSPFGIRQLMISSMNCTTPLRLWDSPCHDRSPDVMLNDTAKSFSGAPSILKKRHRDLLSPVLDRRKDKKLKRAATSSLANDFSRLDVMLDEGDDCMTSRPSESPEDKNICASPSIARDNRNCASARLYQEMIPIDEEPKETLESGGVTSMQNENGCNDGGASAKNVSPSLSLHIIWYQL

SEQ ID NO: 2393 - DNA, 897 bp, Arabidopsis thaliana
  G658
ccacgcgtccgctcacatgaacaaaggagcttggactaaagaagaagatcagcttcttgttgattacatccgtaaacacggtgaaggttgctggcgatctctccctcgcgccgctggattacaaagatgtggtaagagttgtagattgagatggatgaattatctaagaccagatctcaaaagaggcaattttactgaagaagaagatgaactcatcatcaagctccatagcttgctcggtaacaaatggtctttaatagctgggagattaccaggaagaacagataacgagatcaagaactattggaacactcatatcaagaggaagcttctcagccgtgggattgatccaaactctcaccgtctgatcaacgaatccgtcgtgtctccgtcgtctcttcaaaacgatgtcgttgagactatacatcttgatttctctggaccggttaaaccggaaccggtgcgtgaagagattggtatggttaataattgtgagagtagtggaacgacgtcggagaaggattatgggaacgaggaagattgggtgttgaatttggaactctctgttggaccgagttatcggtacgagtcgactcggaaagtgagtgttgttgactcggctgagtcgactcgacggtggggttccgagttgtttggagctcatgagagtgatgcggtgtgtttgtgttgtcggattgggttgtttcgtaatgagtcgtgtcggaattgtcgggtttctgatgttagaactcattagagagtcaatcgagaattctttaggaatctttttatatatttagatcgtcaattgtgttttttttttgttcacatttgttatgtaacatcaagtaagaaactagcataattatttgatggcaaagccaaaagattgtgctc

SEQ ID NO: 2394 - protein, 246 aa, Arabidopsis thaliana
  G658
MNKGAWTKEEDQLLVDYIRKHGEGCWRSLPRAAGLQRCGKSCRLRWMNYLRPDLKRGNFTEEEDELIIKLHSLLGNKWSLIAGRLPGRTDNEIKNYWNTHIKRKLLSRGIDPNSHRLINESVVSPSSLQNDVVETIHLDFSGPVKPEPVREEIGMVNNCESSGTTSEKDYGNEEDWVLNLELSVGPSYRYESTRKVSVVDSAESTRRWGSELFGAHESDAVCLCCRIGLFRNESCRNCRVSDVRTH

SEQ ID NO: 2395 - DNA, 1307 bp, Arabidopsis thaliana
  G670
cacagcattgcagctgtgaataactaaatggggagacattcttgctgttacaaacaaaagctgaggaaagggctttggtctcctgaagaagacgagaagcttcttactcacatcaccaatcacggccatggctgctggagctctgtccctaaactcgctggtttgcagagatgtgggaagagttgtcgactcgagcagatctggtaccgccgactaagatggatcaattacttgagacctgatttaaagagaggagctttttctcctgaagaagagaatctcatcgtcgaacttcatgccgtccttggaaacagatggtcacagattgcgtcaaggcttccgggtagaaccgacaacgagatcaagaatctatggaactcaagcatcaagaagaaactgaaacaaagaggcattgacccaaacacacacaagcccatctctgaagtggagagttttagcgacaaagacaaaccaacaacaagcaacaacaaaagaagcggtaacgatcacaagtctcctagttcctcttctgcgactaaccaagacttcttcctcgaaaggccatctgatttatccgactacttcggatttcagaagcttaacttcaactccaatctaggactctctgttacaactgattcttcactctgctcgatgattccgccgcagtttagccccgggaacatggttggttctgtccttcagacaccagtatgcgtaaagccctcgattagtcttcctcccgacaacaacagttcgagtcctatctccggaggagatcatgtgaaattggctgcaccaaactgggaatttcagacaaacaacaataatacctcaaatttcttcgacaatggcggattctcatggtctatcccaaattcttctacttcttcttcacaagtcaaaccaaatcataacttcgaagaaataaaatggtcagagtatttgaacacaccgttcttcatagggagtactgtacagagtcaaacctctcaaccaatctacatcaaatcagaaacagattacttagccaatgtttcaaacatgacagatccttggagccaaaacgagaacttgggcacaactgaaactagtgacgtgttctccaaggatcttcagagaatggccgtctcttttggtcagtccctttagcttttttctttctttctttcttatttctaacagatgtagagaacataaagatatacaaatacatacaatgtcaatacgtacagtggatttaagtgttctgtatatttcatgggcgagctgtctttatttttatgtttaaaaaaaaaaaaaaaaaa

SEQ ID NO: 2396 - protein, 374 aa, Arabidopsis thaliana
  G670
MGRHSCCYKQKLRKGLWSPEEDEKLLTHITNHGHGCWSSVPKLAGLQRCGKSCRLEQIWYRRLRWINYLRPDLKRGAFSPEEENLIVELHAVLGNRWSQIASRLPGRTDNEIKNLWNSSIKKKLKQRGIDPNTHKPISEVESFSDKDKPTTSNNKRSGNDHKSPSSSSATNQDFFLERPSDLSDYFGFQKLNFNSNLGLSVTTDSSLCSMIPPQFSPGNMVGSVLQTPVCVKPSISLPPDNNSSSPISGGDHVKLAAPNWEFQTNNNNTSNFFDNGGFSWSIPNSSTSSSQVKPNHNFEEIKWSEYLNTPFFIGSTVQSQTSQPIYIKSETDYLANVSNMTDPWSQNENLGTTETSDVFSKDLQRMAVSFGQSL

SEQ ID NO: 2397 - DNA, 840 bp, Arabidopsis thaliana
  G681
atggggaggacgacatggttcgacgtcgacgggatgaagaaaggagagtggacggcagaggaagaccagaagctcggcgcttacatcaacgagcatggcgtttgtgattggcgttccctccccaaaagagctggtttgcagagatgtggaaagagctgcagattaaggtggcttaactatctaaagcctgggattagaagaggcaaattcactcctcaagaagaagaagaaatcatccaacttcatgctgttctcggaaacaggtgggcagccatggcgaagaagatgcagaatcgaacagacaatgatatcaagaaccattggaactcttgtctcaagaaaagactttcgagaaagggaatcgaccctatgacccacgagcccatcatcaaacacctcaccgtcaataccactaacgcagattgtggtaactcttccaccacgacgtccccgtcgacgacggaaagctctccttcctccggctcgtctcgtcttcttaacaaactcgccgcaggtatctcatctagacaacatagtctcgataggatcaagtacatcttgtcgaattcaataatcgaaagcagtgatcaagcaaaagaggaagaagaaaaagaagaagaagaagaagaaagagattcaatgatgggtcagaagattgacggtagtgaaggagaagatattcagatttggggcgaggaggaagttaggcgtttaatggagattgatgcaatggatatgtacgagatgacttcgtacgacgctgtcatgtacgagagtagtcacatacttgatcatctcttttgacttaatatagtgtgactgtgtgagtgcatgcatgtt

SEQ ID NO: 2398 - protein, 267 aa, Arabidopsis thaliana
  G681
MGRTTWFDVDGMKKGEWTAEEDQKLGAYINEHGVCDWRSLPKRAGLQRCGKSCRLRWLNYLKPGIRRGKFTPQEEEEIIQLHAVLGNRWAAMAKKMQNRTDNDIKNHWNSCLKKRLSRKGIDPMTHEPIIKHLTVNTTNADCGNSSTTTSPSTTESSPSSGSSRLLNKLAAGISSRQHSLDRIKYILSNSIIESSDQAKEEEEKEEEEEERDSMMGQKIDGSEGEDIQIWGEEEVRRLMEIDAMDMYEMTSYDAVMYESSHILDHLF

SEQ ID NO: 2399 - DNA, 2299 bp, Arabidopsis thaliana
  G716
  misc_feature (32)..(33): n is a, c, g, or t
  misc_feature (37)..(37): n is a, c, g, or t
  misc_feature (45)..(45): n is a, c, g, or t
  misc_feature (62)..(62): n is a, c, g, or t
  misc_feature (76)..(76): n is a, c, g, or t
  misc_feature (122)..(122): n is a, c, g, or t
  misc_feature (151)..(151): n is a, c, g, or t
aaaaaaaaaggggagagatttagttttatccnncagngcctgaantacgttctgcaatcaanacggacataaccgnccgttgtgtcctgtttataaagttttgctttttttattttctccantgatgggtcttttctttcttctctctctngtgtttctttcatggggttaagactagtgtttaccgcgtgaaggtttttttttctttctattttctttcatttcctctccttctacttcttcttctccagttctcatctgggttcttcaatggcgagtgttgaaggtgatgatgatttcggaagttcttcgtcaaggtcttatcaagatcaactatacacagagctatggaaagtttgtgcaggtccattagtggaagttcctcgtgctcaagagagagttttctacttccctcagggtcacatggaacaacttgtggcgtcaactaatcaaggaatcaattcagaagaaatacctgtttttgatcttcctccaaagatactttgtcgagttcttgatgtcactttaaaggcggagcatgaaacagatgaggtttacgctcagatcacattacaaccagaggaagatcaaagtgaaccaacaagtcttgatccacctattgttggaccaactaagcaagagtttcattcgtttgttaagattttaacggcttcagatacaagcactcatggtggattctctgttcttcgtaaacacgccactgaatgcttgccttctttggatatgacacaagctactcctactcaagaacttgtgactagagatcttcatggctttgaatggaggtttaagcatatattcagaggacaaccacggaggcatttgcttactacgggttggagtacatttgtatcctcgaaaagacttgtagctggagatgcttttgtgttcttgaggggtgagaatggggatttacgggttggagtgagacgattagctcggcatcaaagcacaatgcctacttcggttatttcaagtcagagcatgcatttgggagttcttgctacagcttctcatgctgtgcgtacaacaacaatctttgttgtcttttacaagcctaggataagccaattcatagttggggtgaacaagtatatggaagctataaagcatggattttctctcggtacccgattcagaatgaggtttgaaggagaagagtctcctgagagaatatttactggtacgattgtgggaagtggagatctatcttcacaatggccagcttctaaatggaggtcattgcaggtacaatgggatgagccaacaacagttcagagaccagataaagtctcaccatgggagatagagcctttcttggcaacttccccaatttcaactcctgctcaacaaccacaatcgaaatgcaagcggtcaagacccatcgagccatcagttaaaacaccagccccacctagtttcttgtacagcctccctcagagccaagattccattaatgcatcccttaaactgtttcaagatccatcacttgagagaatttcaggtggatactcctcaaacaacagcttcaaacccgagactcctcctcctccaacgaattgtagctataggttgtttggatttgatctcacaagcaattctcctgctccaatccctcaagacaagcaaccgatggatacttgtggagctgccaagtgtcaagaacccatcactccaacctcaatgagtgagcagaagaagcaacaaacatcaagaagtcgaactaaagtgcaaatgcaaggcattgcggttggtcgtgcggttgatttaacactgttgaaatcttacgatgaactgattgatgagcttgaggagatgtttgagattcaaggacagcttcttgcccgagacaaatggatcgttgtcttcactgatgatgaaggagatatgatgcttgctggtgatgatccgtggaatgagttttgcaagatggcaaagaagatatttatatattcgagcgatgaggttaagaaaatgacaacgaaactgaagatttcttcgtcgttagagaatgaggaatatggtaatgaatcattcgaaaatcgtagtagggggtgagagttttagctgttaattaaggttaattcggcgacgtcgttttagtgcgtaagtgtctaaagactttttttttagtctgtgtatataaagtcttgtcctctttttcatgtcaatttttcaagttggcgatttaatatttcggttttgggacagtggttgatggggcggttttacattttttatgtgtatgtacttgttccaaaaccattcaattttcaaa

SEQ ID NO: 2400 - protein, 602 aa, Arabidopsis thaliana
  G716
MASVEGDDDFGSSSSRSYQDQLYTELWKVCAGPLVEVPRAQERVFYFPQGHMEQLVASTNQGINSEEIPVFDLPPKILCRVLDVTLKAEHETDEVYAQITLQPEEDQSEPTSLDPPIVGPTKQEFHSFVKILTASDTSTHGGFSVLRKHATECLPSLDMTQATPTQELVTRDLHGFEWRFKHIFRGQPRRHLLTTGWSTFVSSKRLVAGDAFVFLRGENGDLRVGVRRLARHQSTMPTSVISSQSMHLGVLATASHAVRTTTIFVVFYKPRISQFIVGVNKYMEAIKHGFSLGTRFRMRFEGEESPERIFTGTIVGSGDLSSQWPASKWRSLQVQWDEPTTVQRPDKVSPWEIEPFLATSPISTPAQQPQSKCKRSRPIEPSVKTPAPPSFLYSLPQSQDSINASLKLFQDPSLERISGGYSSNNSFKPETPPPPTNCSYRLFGFDLTSNSPAPIPQDKQPMDTCGAAKCQEPITPTSMSEQKKQQTSRSRTKVQMQGIAVGRAVDLTLLKSYDELIDELEEMFEIQGQLLARDKWIVVFTDDEGDMMLAGDDPWNEFCKMAKKIFIYSSDEVKKMTTKLKISSSLENEEYGNESFENRSRG

SEQ ID NO: 2401 - DNA, 1221 bp, Arabidopsis thaliana
  G725
cctctttcagagagagaaagagagtcagagagagagagagagagaatgttccatgctaagaaaccttcaagtatgaatggttcatatgagaacagagctatgtgcgttcaaggcgattcaggccttgtcctcaccaccgaccctaaaccgcgtttgcgttggaccgtcgaactccacgagcgttttgtggacgccgtcgctcagctcggcggccccgacaaagcgaccccaaagacgattatgagagttatgggtgtgaagggtcttactctttaccacctaaagagccatcttcagaaattcaggcttggaaagcagccgcacaaggagtacggagatcactccacaaaggaaggttcaagagcttctgccatggatattcagcgcaacgtagcttcttcttctggcatgatgagtcgcaacatgaatgagatgcaaatggaagtgcagagaaggttgcatgaacagctagaggtgcaaagacatctgcaactgaggattgaagcacaaggaaagtacatgcaatctatcttggagagagcttgccaaaccctagccggtgagaacatggcagccgccaccgcagcagccgccgtcggaggaggatacaagggtaatctgggaagttcgagtctttcagcagcggtgggcccacctcctcatcctcttagtttcccgccgtttcaagacctaaacatctatggaaacacaaccgaccaagtcctcgaccatcacaacttccatcatcaaaacatagagaaccatttcacgggtaacaatgctgcagacaccaacatttacttggggaagaagcgacctaatcctaattttggtaacgatgtaaggaaaggactattgatgtggtctgatcaagatcacgatctttccgcaaaccaatcgatcgatgatgagcatagaattcagatacagatggctacacatgtctccacggatttggattctttgtcggagatctacgaaaggaaatcaggtttatcaggtgatgaagggaataatggtgggaaattactggaaaggccatcgcctaggagatcaccattgagtcctatgatgaaccctaatggtggattaatacaaggaagaaactcgccatttgggtgatacaatttattaatttttatctatgagtgatgcatgggaatgtaagaacgagatatatatgttttgtcattgtgagtttgacgtagggtttagagaaaa

SEQ ID NO: 2402 - protein, 358 aa, Arabidopsis thaliana
  G725
MFHAKKPSSMNGSYENRAMCVQGDSGLVLTTDPKPRLRWTVELHERFVDAVAQLGGPDKATPKTIMRVMGVKGLTLYHLKSHLQKFRLGKQPHKEYGDHSTKEGSRASAMDIQRNVASSSGMMSRNMNEMQMEVQRRLHEQLEVQRHLQLRIEAQGKYMQSILERACQTLAGENMAAATAAAAVGGGYKGNLGSSSLSAAVGPPPHPLSFPPFQDLNIYGNTTDQVLDHHNFHHQNIENHFTGNNAADTNIYLGKKRPNPNFGNDVRKGLLMWSDQDHDLSANQSIDDEHRIQIQMATHVSTDLDSLSEIYERKSGLSGDEGNNGGKLLERPSPRRSPLSPMMNPNGGLIQGRNSPFG

SEQ ID NO: 2403 - DNA, 2007 bp, Arabidopsis thaliana
  G727
cttcttctccttctctgatcgttcgttttctggacgagagagatggtaaatccgggtcacggaagaggacccgattcgggtactgctgctggtgggtcaaactccgacccgtttcctgcgaatcttcgagttcttgtcgttgatgatgatccaacttgtctcatgatcttagagaggatgcttatgacttgtctctacagagagcagagagcgcattgtctctgcttcggaagaacaaagaatggttttgatattgtcattagtgatgttcatatgcctgacatggatggtttcaagctccttgaacacgttggtttagagatggatttacctgttatcaatctgaatgttttgaaacctttggttatagtgatgtctgcggatgattcgaagagcgttgtgttgaaaggagtgactcacggtgcagttgattacctcatcaaaccggtacgtattgaggctttgaagaatatatggcaacatgtggtgcggaagaagcgtaacgagtggaatgtttctgaacattctggaggaagtattgaagatactggcggtgacagggacaggcagcagcagcatagggaggatgctgataacaactcgtcttcagttaatgaagggaacgggaggagctcgaggaagcggaaggaagaggaagtagatgatcaaggggatgataaggaagactcatcgagtttaaagaaaccacgcgtggtttggtctgttgaattgcatcagcagtttgttgctgctgtgaatcagctaggcgttgacagtgagttaaaaacttgcttgcttatgcatttgtgtgtgtcgattggtaacattgtggaattccagaagtatcggatatatctgagacggcttggaggagtatcgcaacaccaaggaaatatgaaccattcgtttatgactggtcaagatcagagttttggacctctttcttcgttgaatggatttgatcttcaatctttagctgttactggtcagctccctcctcagagccttgcacagcttcaagcagctggtcttggccggcctacactcgctaaaccagggatgtcggtttctccccttgtagatcagagaagcatcttcaactttgaaaacccaaaaataagatttggagacggacatggtcagacgatgaacaatggaaatttgcttcatggtgtcccaacgggtagtcacatgcgtctgcgtcctggacagaatgttcagagcagcggaatgatgttgccagtagcagaccagctacctcgaggaggaccatcgatgctaccatccctcgggcaacagccgatattgtcaagcagcgtttcaagaagaagcgatctcactggtgcgctggcggttagaaacagtatccccgagaccaacagcagagtgttaccaactactcactcggtcttcaataacttccccgcggatctacctcgcagcagcttcccgttggcaagtgccccagggatttcagttccagtatcagtttcttaccaagaagaggtcaacagctcggatgcaaaaggaggttcatcagctgctactgctggatttggtaacccaagctacgacatatttaacgattttccgcagcaccaacagcacaacaagaacatcagcaataaactaaacgattgggatctgcggaatatgggattggtcttcagttccaatcaggacgcagcaactgcaaccgcaaccgcagcattttccacttcggaagcatactcttcgtcttctacgcagagaaaaagacgggaaacggacgcaacagttgtgggtgagcatgggcagaacctgcagtcaccgagccggaatctgtatcatctgaaccacgtttttatggacggtggttcagtcagagtgaagtcagaaagagtggcggagacagtgacttgtcctccagcaaatacattgtttcacgagcagtataatcaagaagatctgatgagcgcatttctcaaacaggtttgattattactcgaatacagtgcactctaaaac

SEQ ID NO: 2404 - protein, 644 aa, Arabidopsis thaliana
  G727
MVNPGHGRGPDSGTAAGGSNSDPFPANLRVLVVDDDPTCLMILERMLMTCLYREQRAHCLCFGRTKNGFDIVISDVHMPDMDGFKLLEHVGLEMDLPVINLNVLKPLVIVMSADDSKSVVLKGVTHGAVDYLIKPVRIEALKNIWQHVVRKKRNEWNVSEHSGGSIEDTGGDRDRQQQHREDADNNSSSVNEGNGRSSRKRKEEEVDDQGDDKEDSSSLKKPRVVWSVELHQQFVAAVNQLGVDSELKTCLLMHLCVSIGNIVEFQKYRIYLRRLGGVSQHQGNMNHSFMTGQDQSFGPLSSLNGFDLQSLAVTGQLPPQSLAQLQAAGLGRPTLAKPGMSVSPLVDQRSIFNFENPKIRFGDGHGQTMNNGNLLHGVPTGSHMRLRPGQNVQSSGMMLPVADQLPRGGPSMLPSLGQQPILSSSVSRRSDLTGALAVRNSIPETNSRVLPTTHSVFNNFPADLPRSSFPLASAPGISVPVSVSYQEEVNSSDAKGGSSAATAGFGNPSYDIFNDFPQHQQHNKNISNKLNDWDLRNMGLVFSSNQDAATATATAAFSTSEAYSSSSTQRKRRETDATVVGEHGQNLQSPSRNLYHLNHVFMDGGSVRVKSERVAETVTCPPANTLFHEQYNQEDLMSAFLKQV

SEQ ID NO: 2405 - DNA, 834 bp, Arabidopsis thaliana
  G732
aaaaaaaccaaacataaaacataaaactctgtcctttttttgtcttcttgtaacttttcttgttaaaaatcaatggcgtcatctagcagcacataccggagctcaagctcttccgacggtggtaataataacccgtcggactccgtcgtcaccgtcgacgaacgaaaacgtaaaagaatgttatcgaacagagaatctgcacgtaggtcaaggatgcgtaaacagaaacacgttgatgatctaacggctcagatcaatcagctatcaaacgacaaccgtcagatcttgaacagcctcaccgtaacatctcagctttacatgaagatccaagccgagaactctgttctcaccgctcagatggaggagcttagcaccagactccaatctctcaacgagatcgttgatcttgttcaatccaacggtgcaggatttggtgttgaccagatcgacggctgtggttttgatgatcgtacggttgggatcgacggatattacgatgatatgaatatgatgagtaatgttaatcattggggtggttcggtttacactaaccaacccattatggctaatgatatcaatatgtattgattaataaaattaattaaaataattagatgccccttttttgtctttttattttaaaatttagcccattttggtgtttttgggttggtgtgatgatgtaattatagtacatgcatctttgattggttggaaggataaatataaactttatatatatattggggcatatatatatgagttgtactttgcatgtattggtgtgtgttttgttataattatatgattatatatgtttatgttaaaaaaaaa

SEQ ID NO: 2406 - protein, 171 aa, Arabidopsis thaliana
  G732
MASSSSTYRSSSSSDGGNNNPSDSVVTVDERKRKRMLSNRESARRSRMRKQKHVDDLTAQINQLSNDNRQILNSLTVTSQLYMKIQAENSVLTAQMEELSTRLQSLNEIVDLVQSNGAGFGVDQIDGCGFDDRTVGIDGYYDDMNMMSNVNHWGGSVYTNQPIMANDINMY

SEQ ID NO: 2407 - DNA, 885 bp, Arabidopsis thaliana
  G738
atggaccatcatcagtatcatcatcatgatcaataccaacatcagatgatgactagtactaacaataattcctataacaccatcgtcacaacacaaccaccaccaacaacaacaacaatggattcaacaacagcaacaactatgataatggatgacgagaagaagttgatgacgacaatgagcactaggccgcaagaaccaagaaactgtccaagatgcaactcaagcaacaccaagttttgttattacaacaactacagcttagcacagcctaggtacttgtgtaagtcttgtcggagatattggactgaaggtggctctctccgtaacgtccccgtaggcggaggttctagaaagaacaagaagcttccatttcctaattcctctacttcttcttccaccaagaacctcccggatctcaaccctcctttcgtcttcacatcatcagcttcatcatcaaaccctagcaagacgcatcaaaacaataatgacctcagcctatccttctcctcccctatgcaagacaagcgagctcaagggcattacggtcatttcagtgagcaagttgtgacaggagggcagaactgtcttttccaagctcctatgggaatgattcagtttcgtcaagagtatgatcatgagcaccccaaaaagaatcttgggttttcattagacaggaacgaggaagagattggtaatcatgataacttcgttgttaatgaggaaggaagtaagatgatgtatccttatggagatcatgaagaccgtcaacaacatcaccatgtgagacacgatgatggtaataagaagagagaaggtggttcaagcaatgagctatggagcggaatcatcctaggtggtgatagtggtggaccaacatggtga

SEQ ID NO: 2408 - protein, 294 aa, Arabidopsis thaliana
  G738
MDHHQYHHHDQYQHQMMTSTNNNSYNTIVTTQPPPTTTTMDSTTATTMIMDDEKKLMTTMSTRPQEPRNCPRCNSSNTKFCYYNNYSLAQPRYLCKSCRRYWTEGGSLRNVPVGGGSRKNKKLPFPNSSTSSSTKNLPDLNPPFVFTSSASSSNPSKTHQNNNDLSLSFSSPMQDKRAQGHYGHFSEQVVTGGQNCLFQAPMGMIQFRQEYDHEHPKKNLGFSLDRNEEEIGNHDNFVVNEEGSKMMYPYGDHEDRQQHHHVRHDDGNKKREGGSSNELWSGIILGGDSGGPTW

SEQ ID NO: 2409 - DNA, 1212 bp, Arabidopsis thaliana
  G740
cttcttcaacttttttttttaacgatggcttcagaggatcaatcggcggcgagatctaccgggaaggtgaactggttcaacgcttctaaaggctatggtttcattactcctgacgatggcagcgtagagcttttcgttcatcaatcttcaattgtctccgaaggttaccggagtttaaccgtcggcgatgcggttgagttcgctattactcagggaagcgacggtaagactaaagccgtcaatgttactgctcctggtggtggttctctcaagaaggagaataactctcgtggtaacggtgctaggcgcggcggcggtggaagcggttgctacaattgcggtgagttaggtcatatctctaaagattgtggtattggtggcggcggcggaggtggtgaacgtagatctagaggaggagaaggttgttacaattgtggtgatactggtcacttcgctagggattgtacttcagctggaaacggtgaccaacgtggagccaccaaaggtggaaacgatggttgctacacttgcggtgatgttggtcacgtggctagggattgtactcagaaatcagttggaaacggagaccaacgtggagcggtcaaaggtggaaacgatggttgctacacttgtggtgatgttggtcactttgctagggattgtactcagaaggttgctgccggaaacgtcagaagcggtggtggtggtagtggaacttgttattcatgcggtggagttggtcacattgcaagagattgtgcgactaagagacagccttctcgtgggtgttaccagtgtggtggttctggtcacttggctcgtgattgtgaccagagaggaagcggtggaggaggtaatgataatgcgtgctacaagtgtggtaaggaaggtcactttgcaagggaatgttcttctgtagcttaatcgatttcctaatcaacaaaacaaaaaaacaagaatgaaattgaatcgagttatatagtttggtatatattactcttcgttttcatttatctttttttttgttgttgatgggaatgaaattgcctggtccttttggtgtgtttttgagcttttattattatacagagtgatcccttttttgttataactattacaagtttttagctttatttgatatggatgctctctccttttcttctatctgtttctggaaattttgacctcatcatattacttatgtcatccaaa

SEQ ID NO: 2410 - protein, 299 aa, Arabidopsis thaliana
  G740
MASEDQSAARSTGKVNWFNASKGYGFITPDDGSVELFVHQSSIVSEGYRSLTVGDAVEFAITQGSDGKTKAVNVTAPGGGSLKKENNSRGNGARRGGGGSGCYNCGELGHISKDCGIGGGGGGGERRSRGGEGCYNCGDTGHFARDCTSAGNGDQRGATKGGNDGCYTCGDVGHVARDCTQKSVGNGDQRGAVKGGNDGCYTCGDVGHFARDCTQKVAAGNVRSGGGGSGTCYSCGGVGHIARDCATKRQPSRGCYQCGGSGHLARDCDQRGSGGGGNDNACYKCGKEGHFARECSSVA

SEQ ID NO: 2411 - DNA, 1311 bp, Arabidopsis thaliana
  G746
atgggtgaggagttagctgacacaatgaacctggatttgaatcttgggcctggtcctgagtctgatctccaacctgcaccaaacgagactgtgaatttggctgattggactaatgacccgcctgagagatcttctgaagctgtgacaaggatcaggactcggcataggacacggttcagacagcttaatctcccgatcccggttctatctgaaacccataccatggctatagagctcaaccagttgatgggaaattctgtaaatagagctgctatgcagactggtgagggtagtgaaagaggcaatgaggatttgaaaatgtgtgagaatggcgatggagcccttggggacggtgtattggataagaaagcggatgtcgagaaaagcagtggcagcgacggtaactttttcgattgtaatatatgtttggatttgtcgaaggagccggttctcacctgttgtggtcatctttactgttggccttgtctgtaccaatggttacaaatttcggatgcaaaggaatgtcctgtttgtaaaggagaggtgacctccaaaaccgtgacaccgatctatggacgtggaaaccacaagagagaaattgaagagagtttagatactaaggtccccatgagaccacacgcgagacgcattgagagcttgaggaatacaattcaaaggtcgccttttacaataccaatggaagaaatgattagacgtatacagaataggtttgacagggattcaaccccagtccctgattttagtaaccgagaggcatcagaaagagtcaacgatcgagccaattcgatccttaaccggttgatgacatctaggggagttagatcagagcagaaccaggctagtgctgcagcagcagccattgtcgcagcatcagaggatattgatctaaatccaaacattgctcctgatcttgaaggagaaagcaacacgagattccatcctctcttgatcaggagacagttacagtcgcaccgagttgcaaggatctcgactttcacttctgcgttgagttcagctgagaggcttgtggatgcgtattttaggactcatccgttggggaggaaccaccaagagcaaaaccatcatgctcctgttgtggttgatgatagagactcattctcaagcattgcagctgttataaactctgagagtcaagtggatactgcagttgagatcgattctatggctctttcgacatcgtcctcgaggagaaggaatgagaatggttcgagggtttctgatgtagacagtgcagattctcgtccgcctaggagaaggagatttacttga

SEQ ID NO: 2412 - protein, 436 aa, Arabidopsis thaliana
  G746
MGEELADTMNLDLNLGPGPESDLQPAPNETVNLADWTNDPPERSSEAVTRIRTRHRTRFRQLNLPIPVLSETHTMAIELNQLMGNSVNRAAMQTGEGSERGNEDLKMCENGDGALGDGVLDKKADVEKSSGSDGNFFDCNICLDLSKEPVLTCCGHLYCWPCLYQWLQISDAKECPVCKGEVTSKTVTPIYGRGNHKREIEESLDTKVPMRPHARRIESLRNTIQRSPFTIPMEEMIRRIQNRFDRDSTPVPDFSNREASERVNDRANSILNRLMTSRGVRSEQNQASAAAAAIVAASEDIDLNPNIAPDLEGESNTRFHPLLIRRQLQSHRVARISTFTSALSSAERLVDAYFRTHPLGRNHQEQNHHAPVVVDDRDSFSSIAAVINSESQVDTAVEIDSMALSTSSSRRRNENGSRVSDVDSADSRPPRRRRFT

SEQ ID NO: 2413 - DNA, 2001 bp, Arabidopsis thaliana
  G760
tgcttaattccaatgccatcgtgatcgattcatctctctctctctcttccaattttcccaattcttttttaaaaccctaatttttcagatatctgattatctcttgtatttcttctactcgatttgctcccataaaaacccttactttcttcaagttctggttttcaccgattgatgggtcgtggctcagtgacgtcgcttgctcctgggttccgttttcacccgacggatgaggaacttgttcgctactaccttaagcgtaaggtctgcaacaaaccctttaagttcgatgctatttccgtcaccgacatatacaagtctgagccttgggatctaccagataagtcgaagctgaaaagtagagacttggaatggtacttctttagtatgctggataagaagtacagtaatggttccaagacgaatcgtgctacggagaaagggtattggaagacgactgggaaagatcgggagattcgtaatggttcaagagtcgttgggatgaagaagacacttgtttatcacaagggtcgagctcctcgtggtgaaaggaccaattgggttatgcatgagtatcggctttctgatgaggacttgaagaaagctggtgtgccacaagaagcatatgtgttatgtaggatattccagaaaagtggtacgggtcctaagaatggggagcagtatggtgctccttatcttgaggaggagtgggaagaagatggaatgacttatgtacctgctcaagatgctttcagtgaaggattggctttgaatgatgatgtttatgtcgatattgatgacattgacgagaagcccgaaaatctggtggtctatgatgccgttcctattctacctaactattgtcatggggaatcaagtaacaatgttgaatcaggcaattactcagactctggaaattacattcaaccaggaaacaatgttgtcgactctggtgggtactttgaacaaccaattgaaacttttgaggaagatcggaagcctattatacgggagggtagcattcagccttgttctctgtttccagaggaacaaattggctgtggtgtgcaagacgaaaatgtggtgaatctggaatcttccaacaataatgtgtttgtagctgatacatgctacagtgacattcctattgatcataactatttacccgatgagccattcatggatcctaataacaatcttccactcaacgatggtctgtacctggaaacgaatgatctcagctgtgctcaacaagatgattttaacttcgaagattatctcagcttctttgatgatgagggtttgacttttgacgattctctattaatgggacctgaagattttcttcccaaccaagaagcccttgaccagaaacctgcccctaaagaattggagaaggaggtcgcaggaggcaaagaggcagtggaggaaaaggaaagtggcgaaggatcttcttcaaaacaagatacagatttcaaggactttgattcagctccgaagtacccatttctcaaaaagacgagccacatgcttggagccattcctactccatcttcatttgcttcacagttccaaacaaaggacgcaatgcgtctacacgcagcacaatcttctggttcagttcacgtgactgcaggtatgatgagaatatcaaacatgactctagcagcggacagcggtatgggctggtcatatgacaagaacggtaacctcaacgtagtcctttcattcggggtagtccaacaggatgatgcgatgactgcctcgggaagcaagacaggaattacggcgacaagagctatgttagtcttcatgtgtttatgggttctcctactctctgttagcttcaaaatagtaaccatggtgtctgctcggtaataggatcaaagttgaatcgtctcaaagactttttttggtgtttgtacctctccaatcatatagcctttaactttggcagtgctttgctgctcaatatttaaattttaaaaaaaaaaaaaaaaa

SEQ ID NO: 2414 - protein, 567 aa, Arabidopsis thaliana
  G760
MGRGSVTSLAPGFRFHPTDEELVRYYLKRKVCNKPFKFDAISVTDIYKSEPWDLPDKSKLKSRDLEWYFFSMLDKKYSNGSKTNRATEKGYWKTTGKDREIRNGSRVVGMKKTLVYHKGRAPRGERTNWVMHEYRLSDEDLKKAGVPQEAYVLCRIFQKSGTGPKNGEQYGAPYLEEEWEEDGMTYVPAQDAFSEGLALNDDVYVDIDDIDEKPENLVVYDAVPILPNYCHGESSNNVESGNYSDSGNYIQPGNNVVDSGGYFEQPIETFEEDRKPIIREGSIQPCSLFPEEQIGCGVQDENVVNLESSNNNVFVADTCYSDIPIDHNYLPDEPFMDPNNNLPLNDGLYLETNDLSCAQQDDFNFEDYLSFFDDEGLTFDDSLLMGPEDFLPNQEALDQKPAPKELEKEVAGGKEAVEEKESGEGSSSKQDTDFKDFDSAPKYPFLKKTSHMLGAIPTPSSFASQFQTKDAMRLHAAQSSGSVHVTAGMMRISNMTLAADSGMGWSYDKNGNLNVVLSFGVVQQDDAMTASGSKTGITATRAMLVFMCLWVLLLSVSFKIVTMVSAR

SEQ ID NO: 2415 - DNA, 1824 bp, Arabidopsis thaliana
  G761
ggggccgaccggccgcccgggcaggtctaggttcaaaaggactcacaagagagagatagtatgattgatagggaaagagagagagatgaaagaaagtaaaatatataatagattattaggacacgagtgtcatcttttgatttgtgtcttgtgtgctctctctttcttctcttcctcgaatgatcatctttatataaccctactctctttctcttttcccattctttcatatcattctccctttctctctcgggatctgatctctctttccagtaacctattcccgaggagcactgtcaaatcttgtccactctttgatcttatctcgatctctttctctttctagtcttgtgtagtcttcaaacttgtgatgttatctatatagtaatcacgagagagaatcatacaatagctgaaacataaagctttcttagaagctttaaaaaggtctcatctggattatcctgtttaatttctagagtttcttcaggcagattattaaccgatcaagaagacaaacatgaattcattttcccacgtccctccgggttttagatttcacccgacagatgaagaacttgtagactactacctgaggaaaaaagtcgcatcgaagagaatagaaattgatttcataaaggacattgatctttacaagattgagccatgggaccttcaagagttgtgcaaaattgggcatgaagagcagagtgattggtacttctttagccataaagacaagaagtatcccacagggactcgaaccaatagagcaacaaaagcagggttttggaaagccaccggaagagataaggctatctatttgaggcatagtctaattggcatgaggaaaacacttgtgttttacaagggaagagccccaaatggacaaaagtctgattggatcatgcacgaataccgcttagaaaccgatgaaaacggaactcctcaggaagaaggatgggttgtgtgtagggttttcaagaagagattggctgcagttagacgaatgggagattacgactcatccccttcacattggtacgatgatcaactttcttttatggcctccgagctcgagacaaacggtcaacgacggattctccccaatcatcatcagcagcagcagcacgagcaccaacaacatatgccatatggcctcaatgcatctgcttacgctctcaacaaccctaacttgcaatgcaagcaagagctagaactacactacaaccacctgcaatcaaatatcgcgcatgaggaacaattgaatcaaggaaatcagaacttcagctctctatacatgaacagcggcaacgagcaagtgatggaccaagtcacagactggagagttctcgataaatttgttgcttctcagctaagcaacgaggaggctgccacagcttctgcatctatacagaataatgccaaggacacaagcaatgctgagtaccaagttgatgaagaaaaagatccgaaaagggcttcagacatgggagaagaatatactgcttctacttcttcgagttgtcagattgatctatggaagtgagctgaaagagaagacatataaatgcatatatacatatatatatatacgtacacacgaacactaatcaagtgtagatgatgatgatggtacagatttatatttgctttgattgattcttactacattattgaacttatgtcatatgcatatatacattgcgtatctatgcatatttatacttgtactcaatatgattaaccatatataaactctaatctaaatgtaactccaatattttttaaatagacaattgtctcttcttattagaaaaaaaa

SEQ ID NO: 2416 - protein, 342 aa, Arabidopsis thaliana
  G761
MNSFSHVPPGFRFHPTDEELVDYYLRKKVASKRIEIDFIKDIDLYKIEPWDLQELCKIGHEEQSDWYFFSHKDKKYPTGTRTNRATKAGFWKATGRDKAIYLRHSLIGMRKTLVFYKGRAPNGQKSDWIMHEYRLETDENGTPQEEGWVVCRVFKKRLAAVRRMGDYDSSPSHWYDDQLSFMASELETNGQRRILPNHHQQQQHEHQQHMPYGLNASAYALNNPNLQCKQELELHYNHLQSNIAHEEQLNQGNQNFSSLYMNSGNEQVMDQVTDWRVLDKFVASQLSNEEAATASASIQNNAKDTSNAEYQVDEEKDPKRASDMGEEYTASTSSSCQIDLWK

SEQ ID NO: 2417 - DNA, 1213 bp, Arabidopsis thaliana
  G770
ccttcctctatataaggaagttcatttcatttggagaggacacgctgacaagctgactctagcagatctggtaccgtcgacggttcttggatttggagtaaactaaagatcatataaaatggaacaaggagatcatcagcagcataagaaagaagaagaagctttgccaccgggtttcagatttcatccgacggatgaggagctaatctcatattacttggttaataagattgccgatcaaaacttcaccgggaaagcaatcgctgacgttgatcttaacaagtccgagccatgggagcttcctgagaaggcgaaaatgggaggaaaagaatggtacttttttagcctccgggaccggaagtacccgacgggagtgaggacgaatagggcgacgaatacaggatattggaaaaccacaggaaaagacaaagagatattcaatagcacaacctcggagttggtcgggatgaagaagactttggtcttttacagaggacgagctcctcgtggggagaagacttgttgggtcatgcatgagtatcgacttcactccaagtcctcatatagaacctccaagcaagacgagtgggtagtgtgtagagtgttcaagaaaacagaagcaaccaagaaatacataagcaccagtagcagcagcacaagtcatcaccacaacaaccacacaagagcctcaatactatcaaccaacaacaataatcctaattactcatcagacctccttcaactcccaccgcatctacaaccacacccgagcctcaatattaaccaatccctcatggcaaacgccgttcacctagctgagctctcaagagtcttccgtgcctctacaagcaccaccatggactcttctcatcagcagctaatgaactacacccacatgcctgtctcagggctcaacctcaaccttggcggtgcactggtccagccgcctcctgttgtgtctcttgaggatgttgccgcggttagtgcttcgtacaatggcgaaaacgggtttggaaatgtggagatgagccagtgcatggacttggatggatactggccatcttattgattggtaattgtcagtttaagttatggtttttatattgtttccatttacttgttggtaaaacgattttggttgttcttgcgaacgctctagacaggcctcgtaccggatcctctagctagagctttcgttcgtatcatcggtttc

SEQ ID NO: 2418 - protein, 316 aa, Arabidopsis thaliana
  G770
MEQGDHQQHKKEEEALPPGFRFHPTDEELISYYLVNKIADQNFTGKAIADVDLNKSEPWELPEKAKMGGKEWYFFSLRDRKYPTGVRTNRATNTGYWKTTGKDKEIFNSTTSELVGMKKTLVFYRGRAPRGEKTCWVMHEYRLHSKSSYRTSKQDEWVVCRVFKKTEATKKYISTSSSSTSHHHNNHTRASILSTNNNNPNYSSDLLQLPPHLQPHPSLNINQSLMANAVHLAELSRVFRASTSTTMDSSHQQLMNYTHMPVSGLNLNLGGALVQPPPVVSLEDVAAVSASYNGENGFGNVEMSQCMDLDGYWPSY

SEQ ID NO: 2419 - DNA, 1389 bp, Arabidopsis thaliana
  G778
tctcaataacacaaaaccttttaaactagtaaaatacacagattttaggatgagccaatgtgttccaaactgtcacatcgatgatactccggcagcagccaccaccaccgtccgctccaccacagccgcagacatccccatattagactacgaggtagccgagctgacgtgggagaacgggcaactaggcttgcacggcttaggtccaccgcgagtgacggcttcgtcgaccaagtactccacaggcgccggtggaacgttggagtcgatagtggaccaagctactcgcctccctaaccctaagcccacggatgagctcgtcccgtggttccatcatcgctcctccagggccgcgatggcaatggacgcgcttgtcccttgctccaacctagtacacgagcagcagagcaagcctggtggcgttggctccacccgggtggggtcatgtagcgatggtcgtaccatgggcggtggaaaacgagcaagagtggcaccggagtggagcggcggcgggagtcagcggctgaccatggacacttacgacgtaggtttcacctcaacatcaatgggctcgcacgataacacaatcgacgatcatgactccgtctgccacagccgcccacagatggaggacgaagaagagaagaaagccggaggaaaatcatcagtttcaaccaagagaagcagagctgctgctattcataaccaatccgaacgtaagaggagagataaaatcaatcaaaggatgaagactttgcaaaaactggttcccaattccagcaagacggataaagcatctatgttggatgaagtgatagagtatttgaagcaacttcaagcacaagtgagcatgatgagcagaatgaatatgccttctatgatgcttcctatggccatgcagcaacaacaacaactacaaatgtctctcatgtccaatcccatgggtttagggatgggcatggggatgcccggtctcggtctcctcgaccttaattctatgaaccgagctgctgcaagcgctcctaatatccatgccaacatgatgccaaacccatttttgcccatgaattgtccatcgtgggatgcttcttccaatgactctcgatttcagtctcctctcatccccgatcctatgtctgcctttcttgcatgctctactcagccaacgacgatggaagcgtatagcaggatggctacattatatcagcaaatgcaacaacaacttcctcctccttcgaatccaaaatgattattactcaaacacctctatatagtttacgtctatatatgtgttagtcacatacatacatatatatattccatcataattatttatttatatgtataggcttctcatgaattatgatattatacgtattacgtaaaaaa

SEQ ID NO: 2420 - protein, 399 aa, Arabidopsis thaliana
  G778
MSQCVPNCHIDDTPAAATTTVRSTTAADIPILDYEVAELTWENGQLGLHGLGPPRVTASSTKYSTGAGGTLESIVDQATRLPNPKPTDELVPWFHHRSSRAAMAMDALVPCSNLVHEQQSKPGGVGSTRVGSCSDGRTMGGGKRARVAPEWSGGGSQRLTMDTYDVGFTSTSMGSHDNTIDDHDSVCHSRPQMEDEEEKKAGGKSSVSTKRSRAAAIHNQSERKRRDKINQRMKTLQKLVPNSSKTDKASMLDEVIEYLKQLQAQVSMMSRMNMPSMMLPMAMQQQQQLQMSLMSNPMGLGMGMGMPGLGLLDLNSMNRAAASAPNIHANMMPNPFLPMNCPSWDASSNDSRFQSPLIPDPMSAFLACSTQPTTMEAYSRMATLYQQMQQQLPPPSNPK

SEQ ID NO: 2421 - DNA, 1107 bp, Arabidopsis thaliana
  G791
ttttctttgggtgttccttccaccaacggcagaaatcgattcggcttaaatctccccctcctttcgatctctctgatcgccgccgggaacattcaatttcccgggagttcaacaaaaaaaaaactctccgtttttatttttccccctttttcaccggtggaagtttccggagatggtgtcacccgaaaacgctaattggatttgtgacttgatcgatgctgattacggaagtttcacaatccaaggtcctggtttctcttggcctgttcagcaacctattggtgtttcttctaactccagtgctggagttgatggctcggctggaaactcagaagctagcaaagaacctggatccaaaaagagggggagatgtgaatcatcctctgccactagctcgaaagcatgtagagagaagcagcgacgggacaggttgaatgacaagtttatggaattgggtgcaattttggagcctggaaatcctcccaaaacagacaaggctgctatcttggttgatgctgtccgcatggtgacacagctacggggcgaggcccagaagctgaaggactccaattcaagtcttcaggacaaaatcaaagagttaaagactgagaaaaacgagctgcgagatgagaaacagaggctgaagacagagaaagaaaagctggagcagcagctgaaagccatgaatgctcctcaaccaagttttttcccagccccacctatgatgcctactgcttttgcttcagcgcaaggccaagctcctggaaacaagatggtgccaatcatcagttacccaggagttgccatgtggcagttcatgcctcctgcttcagtcgatacttctcaggatcatgtccttcgtcctcctgttgcttaatcaagaaaaatcatcaaccggtttgcttcttgcttccgcttaaaagaaaagtctccatttgttttgctctcctctctttctcggctttcttagtcttatccttttgctttgtcgtgttatcatcgtaactgttatctgttgaacaatgatatgacattgtaaactccaattgcttcgcgcaatgttatctattcacatgtaaatttaagtagagtttggcaaaaaaaaaa

SEQ ID NO: 2422 - protein, 234 aa, Arabidopsis thaliana
  G791
MVSPENANWICDLIDADYGSFTIQGPGFSWPVQQPIGVSSNSSAGVDGSAGNSEASKEPGSKKRGRCESSSATSSKACREKQRRDRLNDKFMELGAILEPGNPPKTDKAAILVDAVRMVTQLRGEAQKLKDSNSSLQDKIKELKTEKNELRDEKQRLKTEKEKLEQQLKAMNAPQPSFFPAPPMMPTAFASAQGQAPGNKMVPIISYPGVAMWQFMPPASVDTSQDHVLRPPVA

SEQ ID NO: 2423 - DNA, 1263 bp, Arabidopsis thaliana
  G804
atactccaagaatttataggttataagtaaaaattcagtacaagtttgtttgtttgtttattccattttcttgtgtgtttttttccccataatttataaattttataagcaatatggagtcccacaacaacaaccagagcaacaacaacaccactggttcggcccatctggtcccatccatgggaccaatctccggttcagtctcattaaccaccactgctccaaactccactaccaccaccgtcaccgccgctaaaacacccgcaaaacgaccgtccaaggaccgtcacatcaaagtagacggacgtggccggaggatacgtatgccggctatctgcgcagcacgtgtcttccaactaacacgtgagttacaacacaaatcggacggcgagactatagagtggctgctccaacaagcggagccagctatcatcgcagccaccggaactggaaccataccggcgaatatctctactttgaacatctctcttcgaagcagtggctctactctttcagctccactgtctaaatctttccacatgggaagagcggctcaaaacgctgccgtttttgggttccagcaacagctttatcatcctcatcatatcacgacagattcttcttcttcttctcttcccaaaacattccgtgaagaagatctttttaaagatcctaattttctagatcaagaacccggttcaagatcacctaaaccgggatccgaagctcctgatcaagatccgggttcgacccggtcaagaacacaaaatatgataccgccgatgtgggcactagcgccaacgccagcctccacaaacggaggtagtgctttttggatgttaccagtcggaggaggaggaggtccggctaacgttcaggatccatcacagcacatgtgggcgtttaatccgggtcattacccgggtcgaatcgggtcggttcagctagggtctatgttagtgggaggtcaacagttagggttaggtgttgcagaaaataacaatttggggctattttccggcggaggaggagacggtggtcgggttggtctcggaatgagtcttgagcaaaagcctcaacatcaagtgagtgatcatgctactagagaccaaaatcctactatagatggttctccttgaaagacttcatgatttctttggtttttaaaaagtgtgaatgtgtgatttattgcaacttttgttgaggactccaatgttaatatgggttttagggttggcttttcgggattgccaaattgttatt

SEQ ID NO: 2424 - protein, 341 aa, Arabidopsis thaliana
  G804
MESHNNNQSNNNTTGSAHLVPSMGPISGSVSLTTTAPNSTTTTVTAAKTPAKRPSKDRHIKVDGRGRRIRMPAICAARVFQLTRELQHKSDGETIEWLLQQAEPAIIAATGTGTIPANISTLNISLRSSGSTLSAPLSKSFHMGRAAQNAAVFGFQQQLYHPHHITTDSSSSSLPKTFREEDLFKDPNFLDQEPGSRSPKPGSEAPDQDPGSTRSRTQNMIPPMWALAPTPASTNGGSAFWMLPVGGGGGPANVQDPSQHMWAFNPGHYPGRIGSVQLGSMLVGGQQLGLGVAENNNLGLFSGGGGDGGRVGLGMSLEQKPQHQVSDHATRDQNPTIDGSP

SEQ ID NO: 2425 - DNA, 1231 bp, Arabidopsis thaliana
  G805
tatagagagaggaaaaaactatggctcacataaagatctaacagagacagtagtatagtcccacttcccccccaccaaagcttcgatcatcatcatcatcatcatcatggatccggatccggatcataaccatcgacccaacttccctctccagcttcttgattcttctacctcctcctcttccacttccttagccatcatctctactacttccgaacctaactccgaacctaagaagcctcctcctaaacgaacctctactaaagaccgacacaccaaagtcgaaggccgaggccgtcggatccgtatgcctgccatgtgtgctgcacgtgtctttcagctcacacgtgagcttggtcacaaatccgacggtgaaactattgagtggctactccaacaagcagaaccagcggttatagccgctacagggactggaaccattccggctaacttcacttctttaaacatctcacttcgtagctcaagatcttctctctctgctgctcatcttcgtacaactcctagtagctattactttcattcaccacatcagtccatgactcatcatcttcaacatcagcatcaggttcgtcccaagaacgagtcacattcttcgtcttcttcttcttcacagcttttagatcacaaccaaatgggtaactatctagtacaatcaactgctggatctttacctacgagtcagagtcctgcaacggcaccgttttggagtagtggtgacaacacacagaatctttgggcttttaatattaatcctcatcattccggtgttgtcgccggagatgtttacaaccccaacagtggtggtagtggcggcggtagtggagttcatttgatgaattttgcagctcctattgctttgttttctggacagcctttggcttctggttatggaggaggaggaggtggcggtggagaacatagccattatggagttttagcggcgttgaatgctgcttaccgaccggtggcggagacggggaaccataacaacaaccagcaaaaccgtgacggagatcatcatcacaaccatcaagaagatggaagcaccagtcatcattcctaggcaaacatacacaaacaaatatattctgtgagatttatttttctttttttgtcctttcgtttgtttgtttgttcttaacaagcgtgttttttttgcattgcttctttttcatatatttttatttatttctaaattctaataaaaaaa

SEQ ID NO: 2426 - protein, 325 aa, Arabidopsis thaliana
  G805
MDPDPDHNHRPNFPLQLLDSSTSSSSTSLAIISTTSEPNSEPKKPPPKRTSTKDRHTKVEGRGRRIRMPAMCAARVFQLTRELGHKSDGETIEWLLQQAEPAVIAATGTGTIPANFTSLNISLRSSRSSLSAAHLRTTPSSYYFHSPHQSMTHHLQHQHQVRPKNESHSSSSSSSQLLDHNQMGNYLVQSTAGSLPTSQSPATAPFWSSGDNTQNLWAFNINPHHSGVVAGDVYNPNSGGSGGGSGVHLMNFAAPIALFSGQPLASGYGGGGGGGGEHSHYGVLAALNAAYRPVAETGNHNNNQQNRDGDHHHNHQEDGSTSHHS

SEQ ID NO: 2427 - DNA, 952 bp, Arabidopsis thaliana
  G812
tcgaaatcatcaagaatcttgtctttaatttccaattgggtttttcaaaacccgttacctcaggatgatgaacccgtttctcccggaaggctgcgatccaccaccaccaccacaaccaatggagggtttacacgaaaatgctccacctccatttctgaccaagacatttgagatggtggatgatccaaacactgaccacatcgtatcttggaacagaggaggaacaagttttgtcgtctgggatttgcattctttctccacgattctccttcctcgtcatttcaaacacagcaatttctcaagtttcatcagacaactcaatacttatggtttcagaaagatagaagcagagagatgggaatttgcaaacgaagagtttttgttaggacaaagacagttgttgaagaacatcaagaggagaaacccttttactccatcatcttcaccaagccatgacgcttgcaacgagcttcgcagagagaagcaagtgctaatgatggagatagtgagtctaagacagcagcaacaaacaacgaaaagctacatcaaagctatggaacagaggatagaaggaacagagaggaaacagagacaaatgatgtcgtttctggctagagcaatgcagagtccttcgtttttgcatcagttgttgaaacaaagagataaaaaaattaaggagcttgaggataatgagtcagcaaagaggaaaagaggttcttcttcgatgtcggaattggaagttttggctttggagatgcaagggcatggaaaacagaggaatatgttggaagaagaggatcatcaactggtggtagagagagagttggatgatggtttctgggaagagttgcttagtgatgagagtttggcttccacctcctaactagatggatttctttttggttttgtttttagtttcttctactttcaagctcattttcttctgtcacaa

SEQ ID NO: 2428 - protein, 272 aa, Arabidopsis thaliana
  G812
MMNPFLPEGCDPPPPPQPMEGLHENAPPPFLTKTFEMVDDPNTDHIVSWNRGGTSFVVWDLHSFSTILLPRHFKHSNFSSFIRQLNTYGFRKIEAERWEFANEEFLLGQRQLLKNIKRRNPFTPSSSPSHDACNELRREKQVLMMEIVSLRQQQQTTKSYIKAMEQRIEGTERKQRQMMSFLARAMQSPSFLHQLLKQRDKKIKELEDNESAKRKRGSSSMSELEVLALEMQGHGKQRNMLEEEDHQLVVERELDDGFWEELLSDESLASTS

SEQ ID NO: 2429 - DNA, 1120 bp, Arabidopsis thaliana
  G818
gtatttcttacaataaacgaccaaaaagttaatacaagaaatagaaacggtgtaggaagctactatgacggcaattccaaacgtcgtcgatattgaatcttcttcctcttcgctttgtcaagagacggcaacggagaccgtcaccgttgaaagaggctcgtctgattcatcttcaaagccagacgacgtcgttttactaatcaaggaagaggaggatgacgccgttaacttgtcacttggtttttggaaattgcacgagataggtttaataacaccgttcttgagaaagacgtttgagatcgtcgatgacaaagtaacagacccggttgtatcatggagcccgacccgtaaaagctttatcatttgggattcttacgagttctcagagaatctacttcccaaatacttcaagcacaagaacttctccagttttattcgtcagcttaactcttacggttttaaaaaggtcgattcagataggtgggaatttgctaacgaagggtttcaaggagggaagaaacatttgcttaagaacatcaagaggagaagcaaaaacactaaatgttgtaacaaggaagcgagtaccaccacgacagagactgaggttgagtcattgaaggaggaacagagtccaatgagattggagatgttgaagctgaaacaacaacaagaagaatctcaacatcagatggtcactgtgcaggagaagatccacggagttgataccgaacaacagcatatgcttagtttctttgcaaagttggctaaagatcaaagatttgtagagagactggtgaagaagagaaagatgaaaatacagagagagctagaagcagctgaattcgtgaagaagctcaagttgcttcaggatcaagaaactcaaaagaacttgttagatgtagaaagagaatttatggccatggctgcaacagaacacaatcccgagcctgacattttggtgaacaatcaaagcgggaatacgagatgtcagcttaactcagaggacctacttgttgacggtggctcaatggatgtaaatgggaggatagagatagagtagagcaaaaccggtaacatagcaatagagaaggtaccaaatcccaaggcttgagatccgaat

SEQ ID NO: 2430 - protein, 331 aa, Arabidopsis thaliana
  G818
MTAIPNVVDIESSSSSLCQETATETVTVERGSSDSSSKPDDVVLLIKEEEDDAVNLSLGFWKLHEIGLITPFLRKTFEIVDDKVTDPVVSWSPTRKSFIIWDSYEFSENLLPKYFKHKNFSSFIRQLNSYGFKKVDSDRWEFANEGFQGGKKHLLKNIKRRSKNTKCCNKEASTTTTETEVESLKEEQSPMRLEMLKLKQQQEESQHQMVTVQEKIHGVDTEQQHMLSFFAKLAKDQRFVERLVKKRKMKIQRELEAAEFVKKLKLLQDQETQKNLLDVEREFMAMAATEHNPEPDILVNNQSGNTRCQLNSEDLLVDGGSMDVNGRIEIE

SEQ ID NO: 2431 - DNA, 2079 bp, Arabidopsis thaliana
  G831
ttctttcatcgttgtgtctattataaatatatgtcaatttggtttctaaaaaattctaccattgattgattgatttttttttctttaagagatgaatttatttacaagaatctcatctcggactaagaaggccaatctttactacgtaaccctagttgctcttctctgcatcgctagctaccttctcggtatttggcaaaacacggcggttaatccacgcgccgccttcgatgattcagacggtacaccgtgcgagggattcaccagacctaattctacgaaagatctcgacttcgacgcgcatcacaacattcaagatccacctccggtgacggaaaccgccgttagtttcccgtcgtgtgccgccgcgttgagcgagcacacgccatgcgaagacgcgaagcgatcgttgaaattctcgagggagagattggagtataggcaaaggcattgtcccgagagagaagaaatcttgaagtgcagaattccggcgccgtacggttacaaaacgccgttccgatggccggcgagtcgtgacgtggcgtggttcgctaatgtgcctcacacggagcttacggttgagaaaaagaatcagaattgggtccggtacgagaatgatcggttttggttccctggtggaggtacgatgtttccacgtggcgctgatgcttacattgatgatatcggacggttgattgatctcagcgacggctctatccgtacagccatcgataccggttgcggggtggctagcttcggtgcatatcttttatcaagaaacattacaacgatgtcatttgcaccaagagacacacacgaagctcaagtccagttcgcactcgagcgtggtgtgccggcgatgatcggaatcatggctacaatccgcctaccgtacccttctagagcctttgatttagcacattgctctcgttgccttattccgtggggccaaaacgatggggcttacttgatggaggtggatagggttttaagaccaggagggtactggatactttctggaccgccgattaattggcagaaacggtggaaagggtgggaacggaccatggatgatttgaatgcagagcagactcagatcgagcaggtcgcgagaagcttgtgttggaagaaagttgttcaaagagatgatcttgctatttggcaaaaaccctttaaccacattgactgtaagaaaaccagagaggttttgaaaaatccggagttttgtcgtcatgatcaagatcccgacatggcctggtatacgaagatggattcttgtttgacaccattacctgaagttgatgacgctgaggatctaaagacggtggccggagggaaggtagaaaagtggccggctagattaaacgcgattcctccgagagtaaacaaaggcgctctcgaggaaatcacacctgaagctttcttggagaacacgaaactgtggaaacagagagtttcttattacaagaagttagattaccagttgggtgaaaccgggagatacagaaacttagtcgacatgaacgcttacctcggtggattcgcggcggctctagcggatgatccggtctgggtcatgaacgttgtcccggtcgaggctaagctcaatacgctcggtgtcatctacgagcgtggtctaatcggaacgtatcaaaactggtgtgaagccatgtcgacgtatccaagaacgtatgattttatccatgctgactcggttttcacattgtaccaaggtcaatgtgaaccggaggagatattgttggagatggaccgaattcttagaccgggtggtggtgtgattataagagatgacgtggacgttttgatcaaggttaaggaattaaccaaaggattagaatgggaaggtagaattgctgaccacgagaagggtcctcatgaaagagagaagatttactatgcggtgaaacagtattggaccgttcctgcgcctgatgaagataaaaacaacactagtgctctctcctgatttttgagttttttttttcttacaatgttttttttttttttttttcaattttttatacaacaataaattctcaataattgttgtcgcggccg

SEQ ID NO: 2432 - protein, 631 aa, Arabidopsis thaliana
  G831
MNLFTRISSRTKKANLYYVTLVALLCIASYLLGIWQNTAVNPRAAFDDSDGTPCEGFTRPNSTKDLDFDAHHNIQDPPPVTETAVSFPSCAAALSEHTPCEDAKRSLKFSRERLEYRQRHCPEREEILKCRIPAPYGYKTPFRWPASRDVAWFANVPHTELTVEKKNQNWVRYENDRFWFPGGGTMFPRGADAYIDDIGRLIDLSDGSIRTAIDTGCGVASFGAYLLSRNITTMSFAPRDTHEAQVQFALERGVPAMIGIMATIRLPYPSRAFDLAHCSRCLIPWGQNDGAYLMEVDRVLRPGGYWILSGPPINWQKRWKGWERTMDDLNAEQTQIEQVARSLCWKKVVQRDDLAIWQKPFNHIDCKKTREVLKNPEFCRHDQDPDMAWYTKMDSCLTPLPEVDDAEDLKTVAGGKVEKWPARLNAIPPRVNKGALEEITPEAFLENTKLWKQRVSYYKKLDYQLGETGRYRNLVDMNAYLGGFAAALADDPVWVMNVVPVEAKLNTLGVIYERGLIGTYQNWCEAMSTYPRTYDFIHADSVFTLYQGQCEPEEILLEMDRILRPGGGVIIRDDVDVLIKVKELTKGLEWEGRIADHEKGPHEREKIYYAVKQYWTVPAPDEDKNNTSALS

SEQ ID NO: 2433 - DNA, 1130 bp, Arabidopsis thaliana
  G858
cataatctcttctctctatatctcttctcttcttcttttaccctgttttttttttcattccacagagcccaggttgattgattttgttattcagagatatggggagaggaaggattgagattaagaagattgagaatatcaacagtcgtcaagtcactttctctaagagacgaaacggtttgatcaagaaggctaaagagctttcgattctctgtgacgccgaggttgctcttatcatcttctccagcaccggcaagatttacgatttctccagcgtctgtatggagcaaattctttctagatatggatacactactgcgtccactgagcataaacaacaaagagaacaccaacttctaatttgtgcttcacatggaaatgaagctgtgttgcgaaatgatgattctatgaagggggaacttgaaagattacagcttgcaattgagagacttaagggtaaggagcttgaaggtatgagtttcccggatcttatttctcttgaaaaccagttgaacgagagcttgcatagtgtcaaggatcaaaagacacaaatcctgctcaaccagattgagagatccaggatacaggagaaaaaagcattggaagaaaaccaaatcttgcgcaaacaggttgagatgttggggagaggttcaggaccaaaagtgttgaatgaaaggcctcaagattctagcccagaagccgatcccgagagctcttcatcagaagaggatgagaatgacaacgaggagcaccattccgacacttccttgcagttggggttgtcgtcgacggggtattgcacaaagagaaagaagccgaagatcgaactggtctgcgataactctgggagtcaagtggcttctgattgatggaatcgattatttttctaattctggttgtttaggggtctctatgtgtcttcttgtttctggctgttcttttgctttatttcatctcaagtagagttttcttaatgtttaggtggaacatttttccataatcaagaagggatttgatcaatcaataacattagattttcttagttaaagacttaaagttgcccacacaccacaccatatgtgattatgatgaatttacattttataaaaaaaaaaaaaaaaaaaaaaaaa

SEQ ID NO: 2434 - protein, 256 aa, Arabidopsis thaliana
  G858
MGRGRIEIKKIENINSRQVTFSKRRNGLIKKAKELSILCDAEVALIIFSSTGKIYDFSSVCMEQILSRYGYTTASTEHKQQREHQLLICASHGNEAVLRNDDSMKGELERLQLAIERLKGKELEGMSFPDLISLENQLNESLHSVKDQKTQILLNQIERSRIQEKKALEENQILRKQVEMLGRGSGPKVLNERPQDSSPEADPESSSSEEDENDNEEHHSDTSLQLGLSSTGYCTKRKKPKIELVCDNSGSQVASD

SEQ ID NO: 2435 - DNA, 1126 bp, Arabidopsis thaliana
  G865
atccccacttgttgttcatcaccaagccaagctccatgtcctagtcactccacagattccctatcatcatcaattcgtttcaaacttagttcctttcaaagtcttgtacatatatacacacacacctattattctcttggtgtgtttgtgtgttacatatacgtgtgagtacatactttgttgtaaaagtggatcggaggtatggaaagggaccggttccaccggaaacatcggcggcggcggatgataattcgtcttggaacgagactgatgtcaccgccatggtctccgctctcagccgtgtcatagagaatccgacagacccgccggtcaaacaagagcttgataaatcggatcaacatcaaccagaccaagatcaaccaagaagaagacactatagaggcgtaaggcagagaccatggggtaaatgggcggcagaaatccgcgatccaaagaaagcagcccgtgtctggctcgggactttcgagacggcagaggaagctgctttagcctatgaccgagctgccctcaaattcaaaggcaccaaggctaaactgaacttccctgaacgggtccaaggccctactaccaccacaaccatttctcatgcaccaagaggagttagtgaatccatgaactcacctcctcctcgacctggtccaccttcaactactactacttcgtggccaatgacttataaccaggacatacttcaatacgctcagttgcttacgagtaacaatgaggttgatttatcatactacacgtcgactctcttcagtcaacctttttcaacgccttcttcatcttcttcttcctcccaacagacgcagcaacagcagctacaacaacaacaacagcagcgtgaagaagaagagaagaattatggttacaattattataactacccaagagaataatctaattattattgttggtcgaatcagttttataaatagctatcatagtttcatttttggtttccgtaacctttgttgcatggaaaatatgaatgaacgagggacatgtgtaacaatttgtttgtgtttcgtaaatgttagttgtatttggatttgctgaagtttgattttctgagcataaatcatttgacggtcaaaaaaaaaaa

SEQ ID NO: 2436 - protein, 212 aa, Arabidopsis thaliana
  G865
MVSALSRVIENPTDPPVKQELDKSDQHQPDQDQPRRRHYRGVRQRPWGKWAAEIRDPKKAARVWLGTFETAEEAALAYDRAALKFKGTKAKLNFPERVQGPTTTTTISHAPRGVSESMNSPPPRPGPPSTTTTSWPMTYNQDILQYAQLLTSNNEVDLSYYTSTLFSQPFSTPSSSSSSSQQTQQQQLQQQQQQREEEEKNYGYNYYNYPRE

SEQ ID NO: 2437 - DNA, 891 bp, Arabidopsis thaliana
  G872
ccggaaacagaatccaattcaaccaaaccgaatcgaaccgaaccggagtttttatccaatggtgaagcaagcgatgaaggaagaggagaagaagagaaacacggcgatgcagtcaaagtacaaaggagtgaggaagaggaaatggggaaaatgggtatcggagatcagacttccacacagcagagaacgaatttggttaggctcttacgacactcccgagaaggcggcgcgtgctttcgacgccgctcaattttgtctccgcggcggcgatgctaatttcaatttccctaataatccaccgtcgatctccgtagaaaagtcgttgacgcctccggagattcaggaagctgctgctagattcgctaacacattccaagacattgtcaagggagaagaagaatcgggtttagtacccggatccgagatccgaccagagtctccttctacatctgcatctgttgctacatcgacggtggattatgatttttcgtttttggatttgcttccgatgaatttcgggtttgattccttctccgacgacttctctggcttctccggtggtgatcgatttacagagattttacccatcgaagattacggaggagagagtttattagatgaatctttgattctttgggatttttgaattcccaaacataatatttttttagagcgaactgtgagattttccttggagtcatggagaaatctggagattttttgtaacacggagctccaatgacccgggaatttctttcgtttcggatccgaatttgatgtggatcatattcacacctatattttttcatttttttgttgtaaagaaaaatcggataagattctagtaataaatgttaaaagtccatttcattaaaaaaaaaaaaaaaaaaa

SEQ ID NO: 2438 - protein, 195 aa, Arabidopsis thaliana
  G872
MVKQAMKEEEKKRNTAMQSKYKGVRKRKWGKWVSEIRLPHSRERIWLGSYDTPEKAARAFDAAQFCLRGGDANFNFPNNPPSISVEKSLTPPEIQEAAARFANTFQDIVKGEEESGLVPGSEIRPESPSTSASVATSTVDYDFSFLDLLPMNFGFDSFSDDFSGFSGGDRFTEILPIEDYGGESLLDESLILWDF

SEQ ID NO: 2439 - DNA, 2044 bp, Arabidopsis thaliana
  G878
caaaaaaaatctctcccattaaaagactgcccaaagaaatattttatacaaaatgaaagagagaaacacgacacgaattttgtataattaagattacacaaaaaaaagtgttagaaagagaaatatcttcttcttttttctgtgtgagttgggtttgttaaagttttatcctttttgttctcaaaatcaagaatcgatggcggagaaggaagaaaaagaaccatcgaagttaaaatcatccaccggagtttcacggccaacgatttcactacctcctcgaccgtttggtgaaatgttttttagcggtggcgttggatttagtcctggaccaatgactctcgtctcaaatttattctctgatcctgatgagttcaagtctttctctcagcttttagctggagctatggcttctccggcggcagctgctgttgccgccgctgctgtggttgctactgctcatcatcagacacctgtgagctctgtcggtgatggcggtggaagcggtggtgatgttgacccgaggtttaagcagagtagaccaacgggattgatgataactcaaccaccggggatgtttactgtaccgccggggttaagtccggctactcttttggattctccgagcttctttggtcttttttcacctcttcagggaacatttggtatgacacatcaacaagctttagcacaagtcactgcacaagcagttcaaggcaataatgttcatatgcagcaatcacaacaatctgaatatccttcttctacacaacaacaacaacaacaacaacaacaagcttcattgactgagattccatcattttcttctgcacctaggtctcagattcgagcctcggttcaagaaacatcgcagggtcagagagagacttcggaaatatctgtctttgagcatcggtcacagcctcaaaatgctgacaaaccagctgatgatggatacaactggcggaaatatgggcagaagcaagtgaaggggagcgattttcctcggagttattacaaatgtacgcatccagcttgtcctgtcaagaagaaagtggagaggtcactcgatggacaagtaacggaaatcatctacaagggtcaacacaatcatgagcttcctcaaaagcgcggtaacaataacgggagttgtaaaagttctgatattgcaaatcagtttcaaacaagtaatagcagtctcaacaagagtaagagggaccaggaaacaagccaagttacaacaacagagcagatgtctgaagcaagtgatagcgaggaggttgggaatgcagagactagtgtgggagaaagacatgaggatgagcctgatcccaagcgaagaaatacagaagttcgggtttcagaaccagttgcttcatcgcatagaactgtgacagagcctaggattattgtccaaacgacgagtgaagttgacctcttagatgatggatataggtggcgcaagtatggtcagaaagtagtcaaaggaaatccttatccgaggagctactataagtgtacaacaccagattgcggagtaaggaaacatgtagagagagcagcaactgacccaaaagctgttgtaacaacatatgaaggtaaacataaccatgatgttccagctgctagaaccagcagccatcagttaagaccaaacaatcaacacaacacctcaacggttaacttcaatcatcaacagcctgttgcacgtttaaggcttaaagaagagcaaatcacttgacagagaagaagaatacgacggcgcttgagcttttgtgagtttaatgaatcttctttttggttaatgaacctgtttttgttgcctcaaaacaccacaggtttctctggacagaatctctgatattacagtttcaaaaggtatgttcttttatttcatgttggaatcttctgtgtaatcttaagaagctttaggaggtaatgtaaaaaaccagattcaaagttatgcccttatgtgaattcttttgtacatgggataaacaaaatttacaggtatcctttttgttcttgttgtaaaaaaaaaaaaaaa

SEQ ID NO: 2440 - protein, 513 aa, Arabidopsis thaliana
  G878
MAEKEEKEPSKLKSSTGVSRPTISLPPRPFGEMFFSGGVGFSPGPMTLVSNLFSDPDEFKSFSQLLAGAMASPAAAAVAAAAVVATAHHQTPVSSVGDGGGSGGDVDPRFKQSRPTGLMITQPPGMFTVPPGLSPATLLDSPSFFGLFSPLQGTFGMTHQQALAQVTAQAVQGNNVHMQQSQQSEYPSSTQQQQQQQQQASLTEIPSFSSAPRSQIRASVQETSQGQRETSEISVFEHRSQPQNADKPADDGYNWRKYGQKQVKGSDFPRSYYKCTHPACPVKKKVERSLDGQVTEIIYKGQHNHELPQKRGNNNGSCKSSDIANQFQTSNSSLNKSKRDQETSQVTTTEQMSEASDSEEVGNAETSVGERHEDEPDPKRRNTEVRVSEPVASSHRTVTEPRIIVQTTSEVDLLDDGYRWRKYGQKVVKGNPYPRSYYKCTTPDCGVRKHVERAATDPKAVVTTYEGKHNHDVPAARTSSHQLRPNNQHNTSTVNFNHQQPVARLRLKEEQIT

SEQ ID NO: 2441 - DNA, 1195 bp, Arabidopsis thaliana
  G883
ctctctcgtcttcgtcttcttcttcttcaacgttcctctccaaaatcctcagaccaagaaatcatcatggccgtcgatctaatgcgtttccctaagatagatgatcaaacggctattcaggaagctgcatcgcaaggtttacaaagtatggaacatctgatccgtgtcctctctaaccgtcccgaacaacaacacaacgttgactgctccgagatcactgacttcaccgtttctaaattcaaaaccgtcatttctctccttaaccgtactggtcacgctcggttcagacgcggaccggttcactccacttcctctgccgcatctcagaaactacagagtcagatcgttaaaaatactcaacctgaggctccgatagtgagaacaactacgaatcaccctcaaatcgttcctccaccgtctagtgtaacactcgatttctctaaaccaagcatcttcggcaccaaagctaagagcgccgagctggaattctccaaagaaaacttcagtgtttctttaaactcctcattcatgtcgtcggcgataaccggagacggcagcgtctccaatggaaaaatcttccttgcttctgctccgtcgcagcctgttaactcttccggaaaaccaccgttggctggtcatccttacagaaagagatgtctcgagcatgagcactcagagagtttctccggaaaagtctccggctccgcctacggaaagtgccattgcaagaaaaggaaaaatcggatgaagagaaccgtgagagtaccggcgataagtgcaaagatcgccgatattccaccggacgaatattcgtggaggaagtacggacaaaaaccgatcaagggctcaccacacccacgtggttactacaagtgcagtacattcagaggatgtccagcgaggaaacacgtggaacgagcattagatgatccagcgatgcttattgtgacatacgaaggagagcaccgtcataaccaatccgcgatgcaggagaatatttcttcttcaggcattaatgatttagtgtttgcctcggcttgacttttttttgtactatttgttttttgattttttgagtactttagatggattgaaatttgtaaatttttttattaagaaatcaatttaaatagagaaaaattagtggtggtgcaaaaaaaaaaaaaaaaaaaaaaaaaaaaaaaaaaaaaaaaaa

SEQ ID NO: 2442 - protein, 324 aa, Arabidopsis thaliana
  G883
MAVDLMRFPKIDDQTAIQEAASQGLQSMEHLIRVLSNRPEQQHNVDCSEITDFTVSKFKTVISLLNRTGHARFRRGPVHSTSSAASQKLQSQIVKNTQPEAPIVRTTTNHPQIVPPPSSVTLDFSKPSIFGTKAKSAELEFSKENFSVSLNSSFMSSAITGDGSVSNGKIFLASAPSQPVNSSGKPPLAGHPYRKRCLEHEHSESFSGKVSGSAYGKCHCKKRKNRMKRTVRVPAISAKIADIPPDEYSWRKYGQKPIKGSPHPRGYYKCSTFRGCPARKHVERALDDPAMLIVTYEGEHRHNQSAMQENISSSGINDLVFASA

SEQ ID NO: 2443 - DNA, 1879 bp, Arabidopsis thaliana
  G884
tttttttttgtttgttaattttggggatcgatgtcggaaaaggaagaagctccgtcgacatcgaagtccaccggagctccgtcgcgtccgactttatctcttcctccacggccgtttagtgagatgttctttaacggtggcgttggattcagtcctggtccgatgactctggtctctaatatgttccctgattccgatgagtttaggtctttctctcagcttctcgctggagccatgtcttctccagcgactgcagctgctgctgctgctgctgcgacggctagtgattaccagagacttggtgaagggactaatagctctagtggtgatgttgacccgagattcaagcaaaacagaccaaccggtttgatgatttctcaatctcaatcgccgtcgatgttcaccgtaccgcctggtttaagtccagctatgttgctcgattcaccaagctttttgggtcttttctctcccgttcagggatcatatggaatgacacatcagcaagctctagctcaagtcactgctcaagcagttcaagccaatgccaatatgcaaccacaaacagagtaccctcctccctctcaagttcaatcattttcatcgggtcaagcgcagatcccgacctcggctccactaccagctcaaagagaaacctcagatgtaaccatcatagagcacaggtcacaacagcctctaaatgttgacaaaccagctgatgatggctataactggcgaaaatatgggcaaaagcaagttaaaggtagcgagtttccacgaagctattacaagtgtactaatccaggatgtcctgtcaagaagaaggttgagagatctcttgatggacaagtaacggagattatctacaaaggtcagcacaatcatgaacctcctcaaaacactaagcgaggtaacaaagataacaccgcgaatataaatgggagttcgataaataacaatcgcgggagttctgaattgggggcatcacagtttcaaactaatagctccaacaagactaagagagagcaacatgaagcagtaagtcaagctacgacaacagagcacttgtctgaggcaagtgacggtgaagaagttggtaatggagaaactgatgtgagagagaaagatgagaatgagcctgatcccaagagaagaagtacagaagttcggatttcagaaccagctcctgctgcttcacatagaactgtgacagagcctagaattattgtccaaacgacgagtgaagttgatcttctagatgatggatataggtggcgtaaatatggacagaaagttgtcaaagggaatccttatccgaggagctactacaagtgcacaacaccaggatgtggtgtgaggaaacatgtagagagagcagcaacagatccaaaagctgtagtaacaacatatgaaggaaaacataaccatgaccttcccgctgctaaatcaagcagccatgccgctgcagcggcacagttaaggccagataatcgacctggcggtttggctaacttaaatcaacagcagcagcaacagcccgttgcgcggctaaggcttaaagaagagcaaacaacttgagagaagaaaactcttgaccgtttttcattacaaaagctttcaaattccactcacacacttgtctgaaaaatctagcagtttgcaggaaagaaacagcttcaagaggttgtagttcttctatgttctggtgtaaaacttaaaagctttttagggttttcagatttctgtttactaatactgtatgtgaattcttttgtacatgaggaagaaaattacagggggatattttgtgttgtatcttttgtgttattgtttcagtaaaagataggtcttacattttgtgtaaaaaaaaaaaaaaaaaaaa

SEQ ID NO: 2444 - protein, 514 aa, Arabidopsis thaliana
  G884
MSEKEEAPSTSKSTGAPSRPTLSLPPRPFSEMFFNGGVGFSPGPMTLVSNMFPDSDEFRSFSQLLAGAMSSPATAAAAAAAATASDYQRLGEGTNSSSGDVDPRFKQNRPTGLMISQSQSPSMFTVPPGLSPAMLLDSPSFLGLFSPVQGSYGMTHQQALAQVTAQAVQANANMQPQTEYPPPSQVQSFSSGQAQIPTSAPLPAQRETSDVTIIEHRSQQPLNVDKPADDGYNWRKYGQKQVKGSEFPRSYYKCTNPGCPVKKKVERSLDGQVTEIIYKGQHNHEPPQNTKRGNKDNTANINGSSINNNRGSSELGASQFQTNSSNKTKREQHEAVSQATTTEHLSEASDGEEVGNGETDVREKDENEPDPKRRSTEVRISEPAPAASHRTVTEPRIIVQTTSEVDLLDDGYRWRKYGQKVVKGNPYPRSYYKCTTPGCGVRKHVERAATDPKAVVTTYEGKHNHDLPAAKSSSHAAAAAQLRPDNRPGGLANLNQQQQQQPVARLRLKEEQTT

SEQ ID NO: 2445 - DNA, 1083 bp, Arabidopsis thaliana
  G898
gaaaaaaagattcaaaaaccctagatttcacaaaatcgattggctgtcaaatttctctccggcgattttcctcgagtgaaattcggctcaaggtgattatagcgatcatcgaatcaaattgattgaagaggtacaaaggttagttactttgagctgaaagatgaacacgtcagaggtgagagtacctcgaggaaatcgacggaggaaagctgtgattgatctgaatgcggtacctgttgatcaagaagggacctctgcttctgttagaactcttacggtgcctattacaccgtctcagcctgctcctacgatgattgatgtcgatgctattgaggatgatgttattgaatcatccgctagtgcttttgctgaagctaaaagcaaatcaagaaatgcacgtcggagacctttgatggttgatgtagagtcaggaggtacgactagattccctgccaacataagcaacaaacgcagaaggattccttctagtgaatctgtcatcgactgtgagcatgcctctgtaaatgatgaagtcaacatgtcttcgagagtgtctagatcaaaggctccagctcctccaccagaagagccaaagtttacatgtccaatctgcatgtgtccctttacggaggagatgtcaaccaagtgcggtcacatcttctgcaagggatgtataaagatggcaatatctcgccagggcaaatgccctacttgtaggaaaaaggttactgcaaaagagctgattcgagttttccttccaaccactagatgagtggtccggcaacatcaccagccaccctgtctaatggtttatcagactatcctcctattcactttggaacattgaagggacttcgttgacttggtatttttgaatattttgctttgttggaagagaaatattcagtgatcaagaagccagaaggccctatcattcgatggatatcattggtaataactctttgtttttagttgttgttctatgtaatttaggtctctgcaaacctctcagtcgatactcttctctcttgatagatgataagatatatggaaaaaaaaattaatattgaatctttactaaaa

SEQ ID NO: 2446 - protein, 203 aa, Arabidopsis thaliana
  G898
MNTSEVRVPRGNRRRKAVIDLNAVPVDQEGTSASVRTLTVPITPSQPAPTMIDVDAIEDDVIESSASAFAEAKSKSRNARRRPLMVDVESGGTTRFPANISNKRRRIPSSESVIDCEHASVNDEVNMSSRVSRSKAPAPPPEEPKFTCPICMCPFTEEMSTKCGHIFCKGCIKMAISRQGKCPTCRKKVTAKELIRVFLPTTR

SEQ ID NO: 2447 - DNA, 648 bp, Arabidopsis thaliana
  G900
atggggaagaagaagtgcgagttatgttgtggtgtagcgagaatgtattgtgagtcagatcaagcgagtttatgttgggattgtgacggtaaagttcacggagctaattttctggtggcgaaacacatgcgttgtcttctatgtagcgcgtgtcagtcacacacgccttggaaagcttctgggctgaatcttggcccaactgtttctatctgtgagtcttgtttagctcgtaagaagaataacaacagctccctcgccgggagggatcagaatcttaaccaagaagaagagatcattggttgtaacgacggagctgagtcttatgatgaggaaagcgatgaggatgaagaagaagaagaagtggagaatcaggttgttccggctgcggtggagcaagaacttccggtggtgagttcgtcgtcttcggttagtagtggtgaaggagatcaggtggtgaaaaggacgagacttgatttggatcttaacctctccgatgaggagaaccaatctagaccattgaaaagattatcgagagacgaaggtttgtcaagatcaactgttgtgatgaatagctcaatcgtgaaattacacggagggaggagaaaagcagagggatgtgatacatcatcgtcgtcttcgttttattga

SEQ ID NO: 2448 - protein, 215 aa, Arabidopsis thaliana
  G900
MGKKKCELCCGVARMYCESDQASLCWDCDGKVHGANFLVAKHMRCLLCSACQSHTPWKASGLNLGPTVSICESCLARKKNNNSSLAGRDQNLNQEEEIIGCNDGAESYDEESDEDEEEEEVENQVVPAAVEQELPVVSSSSSVSSGEGDQVVKRTRLDLDLNLSDEENQSRPLKRLSRDEGLSRSTVVMNSSIVKLHGGRRKAEGCDTSSSSSFY

SEQ ID NO: 2449 - DNA, 1673 bp, Arabidopsis thaliana
  G903
cccgggtcgacccacgcgtccgctctctctctctgaactatacaaaaacctacttttaatttctcttccaagaagtcaagaacccagaagaagacatgacaagtgaagttcttcaaacaatctcaagtggatcaggttttgctcagccacagagctcatcaaccctggatcatgatgaatctctcatcaatcctcctcttgttaagaaaaagagaaatctccctggaaatcctgatccggaagctgaagtgatagctttatcccccacgaccttgatggctacgaaccggttcctatgtgaggtatgtggcaaaggtttccaaagagaccaaaacttacagcttcatcggcgaggacataatcttccatggaagttgaagcagaggacaagcaaagaagtgagaaaacgtgtctacgtttgccccgagaagacatgtgtccaccatcactcctctagagctctaggcgatctcactggaatcaaaaagcatttttgccggaaacacggggagaagaagtggacgtgcgagaaatgtgctaagagatacgcagtccaatctgattggaaagctcattccaagacttgtggtactagagagtaccgttgcgattgtggcaccattttctcaaggcgagacagctttatcactcatagagctttctgcgatgccttagcggaagaaaccgctaagataaacgcagtgtctcatctcaacggtttagccgcggctggagccccaggatcagttaatctcaactatcaatatctcatgggaacattcatcccaccgcttcaaccatttgtaccacaaccgcaaacaaatccaaaccatcatcatcaacattttcagccaccaacttcttcgtcgctctctctatggatgggacaagatatcgcgccgcctcaaccgcaaccggactacgattgggtttttggaaacgctaaggcagcgtctgcttgcattgataataataatactcacgatgagcagattacgcaaaacgcaaacgcaagtttgaccactaccactactctctctgccccttctttattcagcagcgaccaaccacaaaacgcaaacgcaaattcaaacgtgaatatgtccgcgacagctttactacagaaagctgctgaaattggcgctacttctacaacaaccgcagcgaccaatgacccatcaacgtttcttcaaagtttcccgcttaaatccaccgatcaaaccaccagttatgacagtggcgaaaagttttttgctttgttcgggtctaacaacaacattgggttaatgagtcgtagtcatgatcatcaagagatcgagaacgctagaaatgacgttacggttgcgtctgccttggatgaattacagaattacccttggaaacgtagaagagttgatggtggaggtgaagtgggtggaggagggcaaactcgggatttcctcggggttggtgtacaaacgttgtgccatccatcgtctatcaatggatggatttgaaagagtttaaaaatttcggggttaatgcataaattacgtaaaagaagaaggaatcttttgtcatttccaccattttctaagataacatatgtatatggtaatggaagttgttttcttttattaattcaatattctaaaacttatgatatatgtataatgaatgtgtttatcttcaaa

SEQ ID NO: 2450 - protein, 466 aa, Arabidopsis thaliana
  G903
MTSEVLQTISSGSGFAQPQSSSTLDHDESLINPPLVKKKRNLPGNPDPEAEVIALSPTTLMATNRFLCEVCGKGFQRDQNLQLHRRGHNLPWKLKQRTSKEVRKRVYVCPEKTCVHHHSSRALGDLTGIKKHFCRKHGEKKWTCEKCAKRYAVQSDWKAHSKTCGTREYRCDCGTIFSRRDSFITHRAFCDALAEETAKINAVSHLNGLAAAGAPGSVNLNYQYLMGTFIPPLQPFVPQPQTNPNHHHQHFQPPTSSSLSLWMGQDIAPPQPQPDYDWVFGNAKAASACIDNNNTHDEQITQNANASLTTTTTLSAPSLFSSDQPQNANANSNVNMSATALLQKAAEIGATSTTTAATNDPSTFLQSFPLKSTDQTTSYDSGEKFFALFGSNNNIGLMSRSHDHQEIENARNDVTVASALDELQNYPWKRRRVDGGGEVGGGGQTRDFLGVGVQTLCHPSSINGWI

SEQ ID NO: 2451 - DNA, 1005 bp, Arabidopsis thaliana
  G904
atggaatctctcatcaatcccagccatggcggaggaaactacgattctcactcttcttctctcgatagtctcaaaccaagcgtactagtcatcattctcattctcctcatgactcttctcatctccgtttccatttgcttcctcctccgctgtctcaatcgctgtagccaccgctccgttctccctctttcatcttcctcttccgtcgcaaccgtaacttccgattcccgacgattctctggacatcgagtctctcccgaaacagaacggtcctccgtgcttgattcgcttccgattttcaaattctcctccgtcactcgccgatctagctccatgaattccggagattgcgccgtttgtttgtcgaaattcgaaccggaggatcagctccgtcttcttcctctctgttgtcacgcttttcacgccgattgtatcgatatctggctagtctctaaccagacttgtcctctctgtcgctctcctctcttcgcttcagaatctgatctcatgaagtctctcgccgtcgtcggctcaaacaacggcggaggagaaaacagcttccgtctcgaaatcggatccatcagccgtcgtcgtcaaacaccgattccagaatccgttgagcagcatcgaacttactcaatcggttcgttcgattacatagtagacgacgtagattcagaaatctcagagtcaaatttcaaccgtggaaaacaggaagacgcgactacaacaactgccacagcaacggcggttacgactaatccgacgtcgtttgaagctagtttagcggcggatataggtaacgatggttctagaagctggctcaaggattacgttgacagactctcacgaggtatatcgtcgcgtgcaatgtcgtttagaagctctggtagattttttactgggagtagtcgtcggagtgaggaattgacggtgatggatttagaagcgaatcatgccggagaagagataagtgagcttttccggtggctctcaggggtgtga

SEQ ID NO: 2452 - protein, 334 aa, Arabidopsis thaliana
  G904
MESLINPSHGGGNYDSHSSSLDSLKPSVLVIILILLMTLLISVSICFLLRCLNRCSHRSVLPLSSSSSVATVTSDSRRFSGHRVSPETERSSVLDSLPIFKFSSVTRRSSSMNSGDCAVCLSKFEPEDQLRLLPLCCHAFHADCIDIWLVSNQTCPLCRSPLFASESDLMKSLAVVGSNNGGGENSFRLEIGSISRRRQTPIPESVEQHRTYSIGSFDYIVDDVDSEISESNFNRGKQEDATTTTATATAVTTNPTSFEASLAADIGNDGSRSWLKDYVDRLSRGISSRAMSFRSSGRFFTGSSRRSEELTVMDLEANHAGEEISELFRWLSGV

SEQ ID NO: 2453 - DNA, 858 bp, Arabidopsis thaliana
  G917
ttagggttttagaaagatagatcgattgaagatgaggaaaggtaagagagtgataaaaaagatagaggagaaaataaagagacaagtgacattcgcaaagagaaagaagagtctaatcaagaaggcatatgaactctctgttctctgcgatgtccaccttggtctcatcatcttctctcactccaacaggctctacgatttctgctccaactctaccagcatggagaatctcatcatgagataccaaaaggaaaaagaaggtcaaaccactgcagaacacagtttccactcggatcagtgttcagattgcgtgaagacgaaggaatcaatgatgagagagatagagaatcttaagctgaatcttcaattgtacgacggacatggcttgaatctcttgacctacgacgagctcctttcttttgagctccatctcgaatcttctctacaacatgctcgagctcgcaagtctgagttcatgcatcagcagcagcagcaacaaacagatcaaaagcttaagggaaaagaaaagggtcaaggaagctcttgggagcagctgatgtggcaagcagagagacagatgatgacgtgtcaaagacaaaaagatcctgcgccggcgaatgaaggaggagttccttttttacggtggggaacaacccaccgacgttcttcacctccttaagctaccacaaccaggcccaaatacaggcccataacttctctctatctataaaaaacaactgatagtaaaaagtattgacccggtttggttcggttatgttgataccagactattaattaacttcggttagacgtatttacgacttgatgctatctagacctttttgcccttcaaaaaaa

SEQ ID NO: 2454 - protein, 215 aa, Arabidopsis thaliana
  G917
MRKGKRVIKKIEEKIKRQVTFAKRKKSLIKKAYELSVLCDVHLGLIIFSHSNRLYDFCSNSTSMENLIMRYQKEKEGQTTAEHSFHSDQCSDCVKTKESMMREIENLKLNLQLYDGHGLNLLTYDELLSFELHLESSLQHARARKSEFMHQQQQQQTDQKLKGKEKGQGSSWEQLMWQAERQMMTCQRQKDPAPANEGGVPFLRWGTTHRRSSPP

SEQ ID NO: 2455 - DNA, 1296 bp, Arabidopsis thaliana
  G920
aaaaaatctattttcttctctttccactatattacaacatttcttcattctcaaatcatcatactaaaaacctaaaaaaagttacatattcattgtatctttgtgagaaaaaaatggattcgaatagtaacaacacgaaatccataaagagaaaagttgtcgaccaacttgtcgaaggctatgaattcgctactcagcttcagcttctcctttctcatcaacactctaaccagtaccacatcgatgagacccgtcttgtttccgggtcgggttcagtttccggtggtccagatcccgttgatgagctcatgtctaagatcttgggatctttccataaaactatatcggttcttgattcttttgatcccgtcgccgtctctgtccccatcgccgtcgagggttcatggaatgcttcatgtggggatgattcggcgactccggtgagttgcaacggtggagattccggtgagagtaagaagaagagattaggggttggtaagggtaaaagaggatgctacactagaaagacgagatcacatacaaggatcgtggaagctaaaagttctgaagacagatatgcttggaggaaatatggacaaaaggagattcttaataccacattcccaagaagttactttagatgcacacacaagccaacgcaaggatgcaaagcaacaaagcaagttcagaaacaggatcaagattctgagatgttccaaatcacatacattggctaccacacatgcactgccaatgaccaaacgcacgcgaagaccgagccttttgatcaagaaatcattatggattcggaaaagacattggctgctagcactgctcagaaccatgtcaatgctatggtgcaagagcaagagaacaacaccagcagtgtgacagcaatagacgcaggcatggttaaggaggaacaaaataacaatggtgatcagagtaaagattattatgagggctcttcgacaggtgaggacttgtcattggtttggcaagagacgatgatgtttgatgatcatcaaaatcactactattgtggtgaaaccagtactacttctcatcaatttggtttcatcgacaacgatgatcagttttcctccttcttcgactcatattgtgctgattatgaaagaacaagtgctatgtgaacatccaaatctggaatgatgaatcagcactaggtcttctctttgagtatgtctagtttaatgtaatatttttgttgtatgtttgataaaaacaccatatatacttctctttttacaccaaaaaaaaaaaaaaaaaaaaaaa

SEQ ID NO: 2456 - protein, 346 aa, Arabidopsis thaliana
  G920
MDSNSNNTKSIKRKVVDQLVEGYEFATQLQLLLSHQHSNQYHIDETRLVSGSGSVSGGPDPVDELMSKILGSFHKTISVLDSFDPVAVSVPIAVEGSWNASCGDDSATPVSCNGGDSGESKKKRLGVGKGKRGCYTRKTRSHTRIVEAKSSEDRYAWRKYGQKEILNTTFPRSYFRCTHKPTQGCKATKQVQKQDQDSEMFQITYIGYHTCTANDQTHAKTEPFDQEIIMDSEKTLAASTAQNHVNAMVQEQENNTSSVTAIDAGMVKEEQNNNGDQSKDYYEGSSTGEDLSLVWQETMMFDDHQNHYYCGETSTTSHQFGFIDNDDQFSSFFDSYCADYERTSAM

SEQ ID NO: 2457 - DNA, 1130 bp, Arabidopsis thaliana
  G921
  misc_feature (1100)..(1100): n is a, c, g, or t
ccaagatcgactcttacttcgaatctctctcaactttcttcctcagcttacgggaacttccacacatatacatccacaagaacccatatcgaagattcatcctacatatatttacatggatcagtactcatcctctttggtcgatacttcattagatctcactattggcgttactcgtatgcgagttgaagaagatccaccgacaagtgctttggtggaagaattaaaccgagttagtgctgagaacaagaagctctcggagatgctaactttgatgtgtgacaactacaacgtcttgaggaagcaacttatggaatatgttaacaagagcaacataaccgagagggatcaaatcagccctcccaagaaacgcaaatccccggcgagagaggacgcattcagctgcgcggttattggcggagtgtcggagagtagctcaacggatcaagatgagtatttgtgtaagaagcagagagaagagactgtcgtgaaggagaaagtctcaagggtctattacaagaccgaagcttctgacactaccctcgttgtgaaagatgggtatcaatggaggaaatatggacagaaagtgactagagacaatccatctccaagagcttacttcaaatgtgcttgtgctccaagctgttctgtcaaaaagaaggttcagagaagtgtggaggatcagtccgtgttagttgcaacttatgagggtgaacacaaccatccaatgccatcgcagatcgattcaaacaatggcttaaaccgccacatctctcatggtggttcagcttcaacacccgttgcagcaaacagaagaagtagcttgactgtgccggtgactaccgtagatatgattgaatcgaagaaagtgacgagcccaacgtcaagaatcgattttccccaagttcagaaacttttggtggagcaaatggcttcttccttaaccaaagatcctaactttacagcagctttagcagcagctgttaccggaaaattgtatcaacagaatcataccgagaaatagtttagcttcaaattccgttagagtttttagatttgaatttgtcatgagtaagagaaagagagtagattataatccnttgtgatactgaaaaaaaaaaaaaaaaaaa

SEQ ID NO: 2458 - protein, 302 aa, Arabidopsis thaliana
  G921
MDQYSSSLVDTSLDLTIGVTRMRVEEDPPTSALVEELNRVSAENKKLSEMLTLMCDNYNVLRKQLMEYVNKSNITERDQISPPKKRKSPAREDAFSCAVIGGVSESSSTDQDEYLCKKQREETVVKEKVSRVYYKTEASDTTLVVKDGYQWRKYGQKVTRDNPSPRAYFKCACAPSCSVKKKVQRSVEDQSVLVATYEGEHNHPMPSQIDSNNGLNRHISHGGSASTPVAANRRSSLTVPVTTVDMIESKKVTSPTSRIDFPQVQKLLVEQMASSLTKDPNFTAALAAAVTGKLYQQNHTEK

SEQ ID NO: 2459 - DNA, 1180 bp, Arabidopsis thaliana
  G931
ggaggttctttgacagacacatgtatcatcaatcttctctgttgaagcagagagagagagagctaattgttgcctctgagtcacatggataagaaagtttcatttactagctctgtggcacattcaactccaccataccttagtacttccatctcatggggacttccaaccaaatccaatggtgtgactgaatcactgagtttgaaggtggtagatgcaagaccagaacgtcttataaacacaaagaatatcagtttccaggaccaggattcatcttcaactctgtcctctgctcaatcttctaacgatgttacaagtagtggagatgataacccctcaagacaaatctcatttttagcacattcagatgtttgtaaaggatttgaagaaactcaaaggaagcgatttgcaattaaatcaggctcctccacggcaggaatcgctgatattcactcttctccttccaaggctaacttctcatttcactatgccgatccacattttggtggtttaatgcctgcggcttacctaccacaggcaacaatatggaatccccaaatgactcgagttccgctaccattcgatctcatagagaatgagcctgtctttgtcaatgcaaagcaattccatgcaattatgaggaggaggcaacagcgtgctaagctagaggcgcaaaacaaactaatcaaagcccgtaagccgtatcttcatgaatctcgacatgttcacgctcttaaacgacctagaggatctggtggaagattcctaaacaccaaaaagcttcaagaatctacagatccaaaacaagacatgccaatccaacagcaacacgcaacgggaaacatgtcaagatttgtgctttatcagttgcagaacagcaatgactgtgattgttcaaccacttctcgctctgacatcacatctgcttctgacagcgttaatctctttggacactctgaatttctgatatcagattgcccatctcagacaaacccaacaatgtatgttcatggtcaatcaaatgacatgcatggaggtaggaacacacaccatttctctgtccatatctgagccggtggaatctggtaatgtgtacgttcctacaaaaaaagggaagtcatccttggctgctacttcgcttattagctagttcttatttcacacgctttgtccagatatc

SEQ ID NO: 2460 - protein, 328 aa, Arabidopsis thaliana
  G931
MDKKVSFTSSVAHSTPPYLSTSISWGLPTKSNGVTESLSLKVVDARPERLINTKNISFQDQDSSSTLSSAQSSNDVTSSGDDNPSRQISFLAHSDVCKGFEETQRKRFAIKSGSSTAGIADIHSSPSKANFSFHYADPHFGGLMPAAYLPQATIWNPQMTRVPLPFDLIENEPVFVNAKQFHAIMRRRQQRAKLEAQNKLIKARKPYLHESRHVHALKRPRGSGGRFLNTKKLQESTDPKQDMPIQQQHATGNMSRFVLYQLQNSNDCDCSTTSRSDITSASDSVNLFGHSEFLISDCPSQTNPTMYVHGQSNDMHGGRNTHHFSVHI

SEQ ID NO: 2461 - DNA, 1199 bp, Arabidopsis thaliana
  G937
tggaaaaagtttgagtttttaattcgaatcgagaaaaaataaaaatgggttctttaggtgatgagcttagtttgggatcgatctttgggagaggagtttcgatgaatgttgtggcggttgagaaagttgatgaacatgttaagaagcttgaagaagagaagagaaagctcgaaagttgtcaacttgagcttcctctgtctttgcagattttaaacgatgcgattttgtatctgaaggataagagatgttcagagatggagactcaaccattgttgaaagatttcatttctgttaataaacctattcaaggagaaagaggaatagaattgctgaaaagagaggagctaatgagggagaagaagtttcagcaatggaaagctaatgatgatcacactagtaagatcaagagcaagcttgagattaagagaaatgaggagaaatctcctatgttgttgattccaaaggtggaaactggtttaggcctcggtttaagttcgagttcgataagaagaaaagggattgttgcctcatgtggctttacttctaactctatgccacaaccaccaacaccagcagtaccacaacaaccagcatttcttaagcagcaagctttacggaagcaaagaaggtgttggaatccagagttgcatcgccgatttgtcgatgcattgcaacagctaggtggaccgggagtggcaactcctaaacaaattagagaacatatgcaagaagaaggcttaaccaatgatgaagtcaagagtcatttacagaaatacaggttacacatcaggaagccaaattcgaatgcggagaaacaatcagcagttgttttagggtttaacttgtggaattcttcagcacaagatgaagaagagacatgtgaaggaggagaatcattgaagagaagcaatgcgcaatcagattctcctcaaggtcctttgcagttaccgtctacaacaacaacaactggtggagatagtagcatggaagatgttgaagatgctaagtctgagagctttcaactggagagattgagatcaccataaatctcaagaaaccaaactcttgatcacggttttgttattttggattcattactatatctattagtagtgaatgagaacaataattatagaaaggtttatagatatatatatagagaaaaagagagagtgaggatggttcaaattatttgcaga

SEQ ID NO: 2462 - protein, 333 aa, Arabidopsis thaliana
  G937
MGSLGDELSLGSIFGRGVSMNVVAVEKVDEHVKKLEEEKRKLESCQLELPLSLQILNDAILYLKDKRCSEMETQPLLKDFISVNKPIQGERGIELLKREELMREKKFQQWKANDDHTSKIKSKLEIKRNEEKSPMLLIPKVETGLGLGLSSSSIRRKGIVASCGFTSNSMPQPPTPAVPQQPAFLKQQALRKQRRCWNPELHRRFVDALQQLGGPGVATPKQIREHMQEEGLTNDEVKSHLQKYRLHIRKPNSNAEKQSAVVLGFNLWNSSAQDEEETCEGGESLKRSNAQSDSPQGPLQLPSTTTTTGGDSSMEDVEDAKSESFQLERLRSP

SEQ ID NO: 2463 - DNA, 1755 bp, Arabidopsis thaliana
  G938
atgatgatgtttaacgagatgggaatgtatggaaacatggatttcttctcttcctccacatctctcgatgtgtgtccattaccacaagctgaacaagaacctgtagttgaagatgtcgactacaccgatgatgagatggatgtggatgagcttgagaagaggatgtggagagacaaaatgcgtttgaaacgtctcaaggagcaacagagtaagtgtaaagaaggcgtcgatggttcgaaacagaggcagtcgcaagagcaagctaggaggaagaaaatgtctagagcccaagatgggatcttgaagtatatgttgaagatgatggaagtttgtaaagctcaaggctttgtttatggtattattcctgagaagggtaagcctgtgactggtgcttcggataatttgagggaatggtggaaagataaggttaggtttgatcgtaatggtccagctgctattgctaagtatcagtcagagaataatatttctggagggagtaatgattgtaacagcttggttggtccaacaccgcatacgcttcaggagcttcaggacacgactcttggttcgcttttatcggctttgatgcaacattgtgatccaccgcagagacggtttcctttggagaaaggagtttctccaccttggtggcctaatgggaatgaagagtggtggcctcagcttggtttaccaaatgagcaaggtcctcctccttataagaagcctcatgatttgaagaaagcttggaaagtcggtgttttaactgcggtgatcaagcatatgtcgccggatattgcgaagatccgtaagcttgtgaggcaatcaaaatgcttgcaggataagatgacggcgaaagagagtgctacttggcttgccattattaaccaagaagaggttgtggctcgggagctttatcccgagtcatgccctcctctttcttcttcttcatcattaggaagcgggtcgcttctcattaatgattgtagcgagtatgacgttgaaggtttcgagaaggaacaacatggtttcgatgtggaagagcggaaaccagagatagtgatgatgcatcctctagcaagctttggggttgctaaaatgcaacattttcccataaaggaggaggtcgccaccacggtaaacttagagttcacgagaaagaggaagcagaacaatgatatgaatgttatggtaatggacagatcagcaggttacacttgtgagaatggtcagtgtcctcacagcaaaatgaatcttggatttcaagacaggagttcaagggacaaccaccagatggtttgtccatatagagacaatcgtttagcgtatggagcatccaagtttcatatgggtggaatgaaactagtagttcctcagcaaccagtccaaccgatcgacctatcgggcgttggagttccggaaaacgggcagaagatgatcaccgagcttatggccatgtacgacagaaatgtccaaagcaaccaaacgcctcctactttgatggaaaaccaaagcatggtcattgatgcaaaagcagctcagaatcagcagctgaatttcaacagtggcaatcaaatgtttatgcaacaagggacgaacaacggggttaacaatcggttccagatggtgtttgattcgacaccattcgatatggcagcattcgattacagagatgattggcaaaccggagcaatggaaggaatggggaagcagcagcagcagcagcagcagcagcaagatgtatcaatatggttctga

SEQ ID NO: 2464 - protein, 584 aa, Arabidopsis thaliana
  G938
MMMFNEMGMYGNMDFFSSSTSLDVCPLPQAEQEPVVEDVDYTDDEMDVDELEKRMWRDKMRLKRLKEQQSKCKEGVDGSKQRQSQEQARRKKMSRAQDGILKYMLKMMEVCKAQGFVYGIIPEKGKPVTGASDNLREWWKDKVRFDRNGPAAIAKYQSENNISGGSNDCNSLVGPTPHTLQELQDTTLGSLLSALMQHCDPPQRRFPLEKGVSPPWWPNGNEEWWPQLGLPNEQGPPPYKKPHDLKKAWKVGVLTAVIKHMSPDIAKIRKLVRQSKCLQDKMTAKESATWLAIINQEEVVARELYPESCPPLSSSSSLGSGSLLINDCSEYDVEGFEKEQHGFDVEERKPEIVMMHPLASFGVAKMQHFPIKEEVATTVNLEFTRKRKQNNDMNVMVMDRSAGYTCENGQCPHSKMNLGFQDRSSRDNHQMVCPYRDNRLAYGASKFHMGGMKLVVPQQPVQPIDLSGVGVPENGQKMITELMAMYDRNVQSNQTPPTLMENQSMVIDAKAAQNQQLNFNSGNQMFMQQGTNNGVNNRFQMVFDSTPFDMAAFDYRDDWQTGAMEGMGKQQQQQQQQQDVSIWF

SEQ ID NO: 2465 - DNA, 1722 bp, Arabidopsis thaliana
  G939
cagattctatggatatgtataacaacaatatagggatgttccggagtttagtttgtagctcggcgcctccatttacagagggacatatgtgttctgattcgcatacggctttgtgcgatgatctgagtagtgatgaggaaatggaaatagaggagcttgagaagaagatctggagagacaagcagcgtttaaagcggctcaaggaaatggcgaagaacggtctaggaacaagattgttgttgaagcagcaacatgatgattttccagagcactctagtaagagaaccatgtacaaggcacaagatgggatcttgaagtacatgtcgaagacaatggagcgatataaagctcaaggttttgtttatgggattgtgttagagaatgggaaaacggtagcgggatcttctgataatctccgtgaatggtggaaagacaaagtgaggtttgataggaacggcccagctgctataatcaagcaccaaagggatatcaatctttctgatggaagtgattcagggtctgaggttggggattctaccgcacagaagttgcttgagcttcaagatactactcttggagctctgttatcggctctgtttcctcactgcaaccctcctcagaggcggtttccgttggagaaaggcgtgacaccgccatggtggccaacggggaaagaagattggtgggatcaactgtctttacccgttgattttcgaggtgttccgccaccttacaagaagcctcatgatctcaagaagctgtggaaaattggtgttttgattggtgtaatcagacatatggcttctgacattagcaacatacccaatctcgtgagacggtctagaagtttgcaggagaaaatgacgtcaagagaaggcgctttatggctcgctgctctttaccgagaaaaggctattgttgatcaaatagccatgtctagagaaaacaacaacacttctaactttcttgttcctgcaaccggtggagacccagatgttttgtttcctgaatctacagactatgatgttgaactgattggtggcactcatcggaccaatcagcagtatcctgaatttgaaaacaactacaactgtgtttacaagagaaagtttgaagaagattttgggatgccaatgcatccaacactcctaacatgtgagaacagtctctgtccttatagccaaccacatatgggatttcttgacaggaacttaagagagaatcaccaaatgacttgtccttataaagtcacttccttctaccaaccaactaaaccctatggtatgacgggtttaatggttccttgtccggattataacgggatgcagcagcaggttcagagctttcaagaccagtttaatcatcccaacgatctctacagaccaaaagctccacaaagaggcaacgatgacttggttgaggatttgaatccttctccttcgacgctgaatcagaatcttggtttagtcttacctactgacttcaatggaggtgaggaaacagtaggaacagagaacaatctgcataatcaagggcaagagttgcccacatcttggattcagtaaagaaagcttcagagttttctttttatgttttctagtctttatagctttgtctcttgcttattctctcattaaacacagtttttgatctctccatttcatagcccatgtagcaatggagaagattaggtttcataataagttaataaccaaattcaaa

SEQ ID NO: 2466 - protein, 518 aa, Arabidopsis thaliana
  G939
MDMYNNNIGMFRSLVCSSAPPFTEGHMCSDSHTALCDDLSSDEEMEIEELEKKIWRDKQRLKRLKEMAKNGLGTRLLLKQQHDDFPEHSSKRTMYKAQDGILKYMSKTMERYKAQGFVYGIVLENGKTVAGSSDNLREWWKDKVRFDRNGPAAIIKHQRDINLSDGSDSGSEVGDSTAQKLLELQDTTLGALLSALFPHCNPPQRRFPLEKGVTPPWWPTGKEDWWDQLSLPVDFRGVPPPYKKPHDLKKLWKIGVLIGVIRHMASDISNIPNLVRRSRSLQEKMTSREGALWLAALYREKAIVDQIAMSRENNNTSNFLVPATGGDPDVLFPESTDYDVELIGGTHRTNQQYPEFENNYNCVYKRKFEEDFGMPMHPTLLTCENSLCPYSQPHMGFLDRNLRENHQMTCPYKVTSFYQPTKPYGMTGLMVPCPDYNGMQQQVQSFQDQFNHPNDLYRPKAPQRGNDDLVEDLNPSPSTLNQNLGLVLPTDFNGGEETVGTENNLHNQGQELPTSWIQ

SEQ ID NO: 2467 - DNA, 2057 bp, Arabidopsis thaliana
  G940
ttcccctgagaacgacaggagaaagaataaaaaccctaaatttctttaatttcggcgcttcagattatcgttgttaaaggtttttgattgattttgtttaaatgggcgatcttgctatgtccgtagcagacatcaggatggagaatgagcctgatgatttagctagtgataatgttgctgagattgatgtgagtgatgaagagattgatgctgacgaccttgagagacggatgtggaaagatcgtgtcaggcttaaaagaatcaaagagcgacaaaaagctggctctcaaggagctcaaacgaaggagacacctaagaaaatctctgatcaagctcagaggaagaaaatgtctagagctcaagatggtatccttaagtacatgttgaagcttatggaagtctgcaaagttcgcgggtttgtctatggtataataccggaaaagggcaagcctgtgagtggttcctctgacaatataagagcttggtggaaagagaaagtgaagtttgataagaacggtcctgctgctattgctaaatacgaagaggagtgtttagcgtttgggaaatctgatgggaataggaattcacagtttgttctccaggatttgcaagatgctactttagggtctttgttatcttctttgatgcaacattgtgatcctcctcaaaggaagtatccgttggagaaagggacgcctccgccttggtggccaacggggaatgaagaatggtgggtgaaactcggtctgcctaaaagccagagtcctccttaccgaaaacctcatgatctcaagaagatgtggaaggttggagttttaacggcagtgatcaatcatatgttacctgatattgcaaagattaagaggcatgttcgtcagtcgaaatgtttacaggacaagatgacagctaaagagagtgcgatttggttggcggttttgaaccaagaggaatctttgattcagcagcctagcagtgacaatggaaactccaatgtgactgagacacatcgtaggggtaataacgctgacaggaggaaacctgtggtcaacagtgacagtgactatgatgttgatgggacagaggaagcttcaggttcagtttcatctaaagacagtagaagaaatcagattcaaaaagaacaaccaacagccatctcacattcagtaagagatcaagataaagcagagaaacatcgcagaaggaaaagacctcgaattagatccggaactgtcaatcgacaagaggaagaacaacctgaagctcaacaaagaaacatcttacctgatatgaatcatgttgatgcccctctgctagaatataacatcaacggtactcatcaagaggacgatgttgtcgacccaaatattgccttaggaccagaggataatggtctggaactagtggttcctgagttcaataacaactatacttatcttccacttgttaatgaacaaactatgatgcctgtagacgaaaggccaatgctttatggaccaaaccctaaccaagagcttcaatttgggtcagggtacaacttctacaatccctctgcagtgtttgtacataaccaggaagacgacattctccatacacagatagaaatgaatacacaagcaccacctcacaacagtgggttcgaggaggccccaggaggagtacttcaaccccttggtttactcggaaatgaagacggtgtaacagggagtgagttgcctcagtatcagagtggcattctgtctccattgactgacttggactttgactatggtggttttggtgatgatttctcatggtttggagcttagtgtcttgccattttttttgggagattacatagttcaaaaggacatggcaatagtctggctagtacagttactttctcttcttcatttcttctgatcttatattcttcctctttttttcttataatattttcttagatttgttaagagaaacaattttccttttgaataagttgccagaagaactgctttgcccgttgtaatggtctctagggaaagcagttagcgtatcatcatttgtaaatttactgtgag

SEQ ID NO: 2468 - protein, 567 aa, Arabidopsis thaliana
  G940
MGDLAMSVADIRMENEPDDLASDNVAEIDVSDEEIDADDLERRMWKDRVRLKRIKERQKAGSQGAQTKETPKKISDQAQRKKMSRAQDGILKYMLKLMEVCKVRGFVYGIIPEKGKPVSGSSDNIRAWWKEKVKFDKNGPAAIAKYEEECLAFGKSDGNRNSQFVLQDLQDATLGSLLSSLMQHCDPPQRKYPLEKGTPPPWWPTGNEEWWVKLGLPKSQSPPYRKPHDLKKMWKVGVLTAVINHMLPDIAKIKRHVRQSKCLQDKMTAKESAIWLAVLNQEESLIQQPSSDNGNSNVTETHRRGNNADRRKPVVNSDSDYDVDGTEEASGSVSSKDSRRNQIQKEQPTAISHSVRDQDKAEKHRRRKRPRIRSGTVNRQEEEQPEAQQRNILPDMNHVDAPLLEYNINGTHQEDDVVDPNIALGPEDNGLELVVPEFNNNYTYLPLVNEQTMMPVDERPMLYGPNPNQELQFGSGYNFYNPSAVFVHNQEDDILHTQIEMNTQAPPHNSGFEEAPGGVLQPLGLLGNEDGVTGSELPQYQSGILSPLTDLDFDYGGFGDDFSWFGA

SEQ ID NO: 2469 - DNA, 840 bp, Arabidopsis thaliana
  G956
atggaggagacagaaaagaataagggcagcataagtatggttgaggctaatctacctcctggttttagattccatcctagagacgacgagctcgtctgtgactacttaatgagaagaaccgttcgcagcctctatcaaccagttgtcttgatcgacgtcgatcttaacaaatgcgagccttgggacattcctcaaacggcgagagtgggagggaaagaatggtacttttacagccaaaaagaccgtaaatacgcaacaggctacagaacaaaccgggctacggccaccggttattggaaagccaccgggaaagatagagcaatccaaagaaacggtggtcttgtgggtatgagaaagacacttgtgttttaccgaggtcgatcccctaaaggtcgtaaaactgattgggtcatgcatgagtttcgtctccaaggaaaacttcttcaccactcccctaattctctcgaggaagagtgggtattgtgtagagttttccacaagaacagcaacggagctgatatagacgacatcacaaggagctgctctgatgcaacagcttctgcattcatggactcttacatcaacttcgaccatcatcacatcatcaatcagcatgtaccctgcttctccaataatttgtcacataaccaaaccaaccaatccggtttaatctccaagaactccagcccattgtttaatgcttcccctgatcaaatgattctcagaactttgctaagtcaactcacaaaaaaagtcgaagaatcacagagtcgtggagacggaagctcagagagccaattgaccgacattggcatcccaagccatgcatggaattactga

SEQ ID NO: 2470 - protein, 279 aa, Arabidopsis thaliana
  G956
MEETEKNKGSISMVEANLPPGFRFHPRDDELVCDYLMRRTVRSLYQPVVLIDVDLNKCEPWDIPQTARVGGKEWYFYSQKDRKYATGYRTNRATATGYWKATGKDRAIQRNGGLVGMRKTLVFYRGRSPKGRKTDWVMHEFRLQGKLLHHSPNSLEEEWVLCRVFHKNSNGADIDDITRSCSDATASAFMDSYINFDHHHIINQHVPCFSNNLSHNQTNQSGLISKNSSPLFNASPDQMILRTLLSQLTKKVEESQSRGDGSSESQLTDIGIPSHAWNY

SEQ ID NO: 2471 - DNA, 2022 bp, Arabidopsis thaliana
  G958
cgtcgacatgttcatatttgtttctagctaagaagtttgtataaggcagtggacatggctcctgtttcaatgcctccaggtttccggtttcatccaacagacgaagagcttgtcatatactacctcaagcgaaagattaatggtcggactattgagttagagataatacccgagattgatctttacaaatgcgaaccttgggatttacctgggaagtccttgctgccaagtaaagacctagaatggttctttttcagtcctcgagaccggaaatatccaaacggatcaagaacaaaccgggcgaccaaagcaggttactggaaagccaccgggaaagatcgtaaagtgacttcacattcacggatggttggaacaaagaaaacattagtttattaccgaggaagagcgcctcatggctctcgtaccgattgggtcatgcacgagtaccgtcttgaagaacaagaatgtgactctaaatccggtatacaggatgcctatgcactttgtcgagtatttaagaagagtgctttagccaacaaaattgaagaacaacaccatggtacgaagaagaacaaaggaacgactaatagtgaacaatctacttctagtacttgtttgtattctgatggaatgtatgaaaacctcgaaaactcggggtatccagtctcacctgagacaggaggcttaactcaactcggtaataattcgtcgtcggatatggaaacgatagagaataaatggagtcagtttatgtcgcatgacacgtccttcaacttcccacctcagtctcaatatggaacaatctcatatcctccctcgaaggttgatatagcgttagagtgtgcaagactacaaaatcgtatgttgccaccagtaccaccactttacgtagaaggtctcacacacaatgaatattttggaaacaatgtagctaacgatacagatgaaatgttgagcaagattatagcattggctcaagcctcacatgagccacgaaacagtctagactcatgggacggtggttctgcttccgggaacttccatggagactttaactattccggagaaaaagtctcatgcctagaggcgaacgtggaggctgtagatatgcaagaacaccatgtgaattttaaggaagaaagacttgttgaaaacttgagatgggtaggagtatcaagcaaggaacttgaaaagagcttcgttgaagaacactcaacggtaattcctatagaagatatttggagatatcataatgataatcaagaacaagaacatcatgatcaagatggtatggacgttaacaacaacaatggagatgtggatgatgctttcacactcgagttttcggaaaacgaacataacgagaatcttttggacaagaacgatcatgagacaacgagttcctcatgttttgaggtggtaaaaaaagttgaggttagccatggattgtttgtcacaactcgtcaggtaaccaacacattcttccaacagatagtaccatcgcaaaccgttatagtttatataaatccgacggatggcaatgagtgttgtcatagtatgacatcaaaagaggaggttcatgtccgtaaaaagataaatccgcgaatcaacggagtaagctcaacagttcttggacaatggagaaaattcgcgcatgttattggcttcattcctatgcttctattgatgcgttgtgttcatcgaggtaactctaacaaaaacagaggcagtgaaggttactcgaggcagcctacgagaggagattgtaacaatcggggaacaatactcatgatggaaaatgctgtcgtgagaagaaaaatttggaagaagaagaaagagaaaaatatggttgacgaacaaggttttcggtttcaagatagtttcgtattgaagaagttggggctttctcttgctatcatcttagctgtttctaccataagtcttatttgaatactgaggttcaatatatcatatatggcttttcacttttctattgtactcccatttgcctaggtcgtatgc

SEQ ID NO: 2472 - protein, 631 aa, Arabidopsis thaliana
  G958
MAPVSMPPGFRFHPTDEELVIYYLKRKINGRTIELEIIPEIDLYKCEPWDLPGKSLLPSKDLEWFFFSPRDRKYPNGSRTNRATKAGYWKATGKDRKVTSHSRMVGTKKTLVYYRGRAPHGSRTDWVMHEYRLEEQECDSKSGIQDAYALCRVFKKSALANKIEEQHHGTKKNKGTTNSEQSTSSTCLYSDGMYENLENSGYPVSPETGGLTQLGNNSSSDMETIENKWSQFMSHDTSFNFPPQSQYGTISYPPSKVDIALECARLQNRMLPPVPPLYVEGLTHNEYFGNNVANDTDEMLSKIIALAQASHEPRNSLDSWDGGSASGNFHGDFNYSGEKVSCLEANVEAVDMQEHHVNFKEERLVENLRWVGVSSKELEKSFVEEHSTVIPIEDIWRYHNDNQEQEHHDQDGMDVNNNNGDVDDAFTLEFSENEHNENLLDKNDHETTSSSCFEVVKKVEVSHGLFVTTRQVTNTFFQQIVPSQTVIVYINPTDGNECCHSMTSKEEVHVRKKINPRINGVSSTVLGQWRKFAHVIGFIPMLLLMRCVHRGNSNKNRGSEGYSRQPTRGDCNNRGTILMMENAVVRRKIWKKKKEKNMVDEQGFRFQDSFVLKKLGLSLAIILAVSTISLI

SEQ ID NO: 2473 - DNA, 1652 bp, Arabidopsis thaliana
  G960
taccgtcgacccacgcgtccgagtgtattcaaagtcggaaagaaaccctaaagaagaggattatgggtgctgtatcgatggagtcgcttcctttaggtttcagattcagacctaccgatgaagagctcgtcaatcactacctccgtctcaagatcaacggacgtcactccgatgtccgtgtcatccctgatatcgatgtctgcaaatgggaaccttgggatcttcctgctctctcggtgattaagacggatgatccagagtggttctttttctgccctcgtgatcggaaataccctaatggtcatcgctctaacagagcaactgactctggctattggaaagctactggtaaagatcgtagcatcaagtctaagaagactttaatcggtatgaagaagactcttgtcttctatcgtggacgagctcctaaaggtgagcggactaattggattatgcacgagtatcgtcccactcttaaggatcttgatggcacttcccctggccaaagcccttacgttctttgtcgcctcttccacaagcctgatgatcgggttaatggtgtcaagtccgatgaagcagcttttacggccagcaacaaatactcacctgatgatacatcatctgatcttgttcaagaaacaccttcctctgatgctgctgttgagaaaccatcagattattcaggtggatgcggttatgctcatagtaatagtaccgcagatgggacaatgattgaggcacctgaagagaatctttggttatcttgtgaccttgaagatcaaaaggcaccactaccgtgtatggattctatatatgctggtgatttcagttacgatgagattggattccaatttcaagatggtaccagcgaaccagatgtatcactaacagaattgttggaggaggtgttcaataaccctgatgacttctcttgcgaggaatcgatcagtcgagagaatccagcagtctcaccaaatgggatattttcatctgctaaaatgctgcagtctgcagcaccagaggatgctttcttcaacgacttcatggctttcactgatacagatgctgagatggcgcaattgcagtatggttcagaaggtggagcttctggttggccaagtgacactaattcatactatagtgatttggttcagcaagagcaaatgatcaatcataacacagagaacaacctcacagaagggagagggataaagatccgggctcgacagcctcagaaccggcagagtacaggattgataaaccagggtattgctccaaggagaatccgtctgcagctgcagtctaactctgaagtaaaagaacgagaggaggtgaatgaaggacacactgttattcccgaggccaaagaagctgcagctaaatactcagagaagagtggttctttggttaaacctcaaataaagctcagggcgcggggaactataggccaagtaaaaggagagagatttgcagacgacgaggtacaggtgcagagcacaaagagagagagagagagaatcaaatgtagtttaatgtaattagggatgatgcaatgttagcatgtttgtgtgttgtaacttaaaaacttatttaggaatctgataaaagttactgttgaaaaaagaaaaaaaaaaaaaaaaaaaaaaaaaaaa

SEQ ID NO: 2474 - protein, 491 aa, Arabidopsis thaliana
  G960
MGAVSMESLPLGFRFRPTDEELVNHYLRLKINGRHSDVRVIPDIDVCKWEPWDLPALSVIKTDDPEWFFFCPRDRKYPNGHRSNRATDSGYWKATGKDRSIKSKKTLIGMKKTLVFYRGRAPKGERTNWIMHEYRPTLKDLDGTSPGQSPYVLCRLFHKPDDRVNGVKSDEAAFTASNKYSPDDTSSDLVQETPSSDAAVEKPSDYSGGCGYAHSNSTADGTMIEAPEENLWLSCDLEDQKAPLPCMDSIYAGDFSYDEIGFQFQDGTSEPDVSLTELLEEVFNNPDDFSCEESISRENPAVSPNGIFSSAKMLQSAAPEDAFFNDFMAFTDTDAEMAQLQYGSEGGASGWPSDTNSYYSDLVQQEQMINHNTENNLTEGRGIKIRARQPQNRQSTGLINQGIAPRRIRLQLQSNSEVKEREEVNEGHTVIPEAKEAAAKYSEKSGSLVKPQIKLRARGTIGQVKGERFADDEVQVQSTKRERERIKCSLM

SEQ ID NO: 2475 - DNA, 1444 bp, Arabidopsis thaliana
  G962
cgtcgactctctactcaacaccactcaatttcatctctctttttcccttccattgttagtataaaaaccaagcaaacccttaatcacttttcatcatcatatatcaccttaatccacatgcatacacatatctagtctttttgatatatggcaattgtatcctccacaacaagcatcattcccatgagtaaccaagtcaacaataacgaaaaaggtatagaagacaatgatcatagaggcggccaagagagtcatgtccaaaatgaagatgaagctgatgatcatgatcatgacatggtcatgcccggatttagattccatcctaccgaagaagaactcatagagttttaccttcgccgaaaagttgaaggcaaacgctttaatgtagaactcatcactttcctcgatctttatcgctatgatccttgggaacttcctgctatggcggcgataggagagaaagagtggtacttctatgtgccaagagatcggaaatatagaaatggagatagaccgaaccgagtaacgacttcaggatattggaaagccaccggagctgataggatgatcagatcggagacttctcggcctatcggattaaagaaaaccctagttttctactctggtaaagcccctaaaggcactcgtactagttggatcatgaacgagtatcgtcttccgcaccatgaaaccgagaagtaccaaaaggctgaaatatcattgtgccgagtgtacaaaaggccaggagtagaagatcatccatcggtaccacgttctctctccacaagacatcataaccataactcatcgacatcatcccgtttagccttaagacaacaacaacaccattcatcctcctctaatcattccgacaacaaccttaacaacaacaacaacatcaacaatctcgagaagctctccaccgaatattccggcgacggcagcacaacaacaacgaccacaaacagtaactctgacgttaccattgctctagccaatcaaaacatatatcgtccaatgccttacgacacaagcaacaacacattgatagtctctacgagaaatcatcaagacgatgatgaaactgccattgttgacgatcttcaaagactagttaactaccaaatatcagatggaggtaacatcaatcaccaatactttcaaattgctcaacagtttcatcatactcaacaacaaaatgctaacgcaaacgcattacaattggtggctgcggcgactacagcgacaacgctaatgcctcaaactcaagcggcgttagctatgaacatgattcctgcaggaacgattccaaacaatgctttgtgggatatgtggaatccaatagtaccagatggaaacagagatcactatactaatattccttttaagtaatttaattagatcatgattattatccatgacaataattaatgctgctttgcgc

SEQ ID NO: 2476 - protein, 414 aa, Arabidopsis thaliana
  G962
MAIVSSTTSIIPMSNQVNNNEKGIEDNDHRGGQESHVQNEDEADDHDHDMVMPGFRFHPTEEELIEFYLRRKVEGKRFNVELITFLDLYRYDPWELPAMAAIGEKEWYFYVPRDRKYRNGDRPNRVTTSGYWKATGADRMIRSETSRPIGLKKTLVFYSGKAPKGTRTSWIMNEYRLPHHETEKYQKAEISLCRVYKRPGVEDHPSVPRSLSTRHHNHNSSTSSRLALRQQQHHSSSSNHSDNNLNNNNNINNLEKLSTEYSGDGSTTTTTTNSNSDVTIALANQNIYRPMPYDTSNNTLIVSTRNHQDDDETAIVDDLQRLVNYQISDGGNINHQYFQIAQQFHHTQQQNANANALQLVAAATTATTLMPQTQAALAMNMIPAGTIPNNALWDMWNPIVPDGNRDHYTNIPFK

SEQ ID NO: 2477 - DNA, 897 bp, Arabidopsis thaliana
  G963
atgagtttgcctccaggattcaggtttcatcccactgatgaagaactggtggcttactatcttgataggaaggtcaacggccaagccattgagctcgagatcatcccagaagttgatctttataaatgcgagccatgggacttgcctgaaaagtcatttttgccgggaaacgacatggaatggtacttttacagcacaagggataagaagtatccaaatggctctaggacgaaccgtgcgacccgagcgggttactggaaggccacggggaaagatcgtacagtagaatcaaagaagatgaagatgggaatgaagaagacactggtttattatagaggaagggctcctcatggccttcgtactaattgggtcatgcatgaatatcgtctcacgcacgctccttcctcctccttgaaggagtcgtatgcattgtgccgagtgtttaagaagaacatacaaattccaaagagaaaaggggaagaagaagaagcagaagaagagagcactagtgtaggaaaagaagaggaagaagaaaaggagaagaagtggagaaaatgtgatggtaattatattgaagacgagagcttgaaaagagcatccgcggagacatcttcatcagagctaactcaaggggtccttttagacgaagcaaacagctcatccatatttgctcttcatttctcatcttctcttctggacgatcatgatcatcttttctcaaactattctcatcagcttccatatcatcctcctcttcaactccaagatttccctcaactttctatgaacgaagcagagattatgtcaatccaacaagactttcaatgcagagactctatgaacgggacacttgacgaaatcttctcttcttccgccactttccccgcttccctttga

SEQ ID NO: 2478 - protein, 298 aa, Arabidopsis thaliana
  G963
MSLPPGFRFHPTDEELVAYYLDRKVNGQAIELEIIPEVDLYKCEPWDLPEKSFLPGNDMEWYFYSTRDKKYPNGSRTNRATRAGYWKATGKDRTVESKKMKMGMKKTLVYYRGRAPHGLRTNWVMHEYRLTHAPSSSLKESYALCRVFKKNIQIPKRKGEEEEAEEESTSVGKEEEEEKEKKWRKCDGNYIEDESLKRASAETSSSELTQGVLLDEANSSSIFALHFSSSLLDDHDHLFSNYSHQLPYHPPLQLQDFPQLSMNEAEIMSIQQDFQCRDSMNGTLDEIFSSSATFPASL

SEQ ID NO: 2479 - DNA, 1221 bp, Arabidopsis thaliana
  G964
atttctcttccacaaagagtcctaacttcgagttgaaacaaacaccatttctcatctctatctcagaaagaacaaaccatttcgtgttctttctttctctattctcataaggaaatataattcctgaaactgttgagttcttgtgaaaggaaataaaaaacatgatgatgggcaaagaagatctaggtttgagcctaagcttagggttttcacaaaatcacaatcctcttcagatgaatctgaatcctaactcttcattatcaaacaatctccagagactcccatggaaccaaacattcgatcctacatcagatcttcgcaagatagacgtgaacagttttccatcaacggttaactgcgaggaagacacaggagtttcgtcaccaaacagtacgatctcaagcaccattagcgggaagagaagtgagagagaaggaatctccggaaccggcgttggctccggcgacgatcacgacgagatcactccggatcgagggtactcacgtggaacctcagatgaagaagaagacgggggcgaaacgtcgaggaagaagctcaggttatcaaaagatcagtctgcttttctcgaagagactttcaaagaacacaacactctcaatcccaaacagaagctagctttggctaagaagctgaacttgacggcaagacaagtggaagtgtggttccaaaacagaagagctagaaccaagttaaagcaaacggaggtagattgcgaatacttgaaacggtgcgtagagaagctaacggaagagaaccggagacttcagaaagaggctatggagcttcgaactctcaagctgtctccacaattctacggtcagatgactccaccaactacactcatcatgtgtccttcgtgcgagcgtgtagctggtccatcatcatcgaaccatcaccacaatcacaggccggtttcgattaacccgtggattgcttgtgctggtcaggtggctcatgggctgaattttgaagccttgcgtccacgatcgtaatttttagtggtgggggaagggtgttttgggttttttcattatcgttatatagtctatctgtgtggggtcattgtaattttggatgattggccttctcatgaactagtcatatgtatgatgcaaccttaaaaatatttcaagtagcaaaacttaattacaaacttgctatattaaccaaaaattatgaaaaaaaaaaaaaaaaaaaaaa

SEQ ID NO: 2480 - protein, 283 aa, Arabidopsis thaliana
  G964
MMMGKEDLGLSLSLGFSQNHNPLQMNLNPNSSLSNNLQRLPWNQTFDPTSDLRKIDVNSFPSTVNCEEDTGVSSPNSTISSTISGKRSEREGISGTGVGSGDDHDEITPDRGYSRGTSDEEEDGGETSRKKLRLSKDQSAFLEETFKEHNTLNPKQKLALAKKLNLTARQVEVWFQNRRARTKLKQTEVDCEYLKRCVEKLTEENRRLQKEAMELRTLKLSPQFYGQMTPPTTLIMCPSCERVAGPSSSNHHHNHRPVSINPWIACAGQVAHGLNFEALRPRS

SEQ ID NO: 2481 - DNA, 1983 bp, Arabidopsis thaliana
  G965
gattctctgtgtatgtctgaatccttacaggatccaagagctttggaaaaaagatataatgaataacaagatatgggtttagctactacaacttcttctatgtcacaagattatcatcatcaccaaggaatcttttccttctctaatggattccaccgatcatcatcaaccactcatcaggaggaagtagatgaatccgccgtcgtctccggtgctcaaattccggtttatgaaaccgccggaatgttgtctgaaatgtttgcttaccctggcggaggtggcggcggttccggtggagagattcttgatcagtctactaaacagttgctagagcaacaaaaccgtcacaacaacaacaataactcaactcttcatatgttattaccaaatcatcatcaaggttttgctttcaccgacgaaaacactatgcagccgcagcaacaacaacactttacatggccatcttcctcctccgatcatcatcaaaaccgagatatgatcggaaccgtccacgtggaaggaggaaagggtttgtctttatctctctcatcttcattagccgcagctaaagccgaggaatatagaagcatttattgtgcagccgttgatggaacttcttcttcttctaacgcatccgctcatcatcatcaattcaatcagttcaagaatcttcttcttgagaattcttcttctcaacatcatcaccatcaagttgttggacattttggttcatcatcatcatctcccatggcggcttcttcatccattggagggatctacacgttgaggaattcgaaatatacgaaaccggctcaagagttgttggaagagttttgtagtgttggaagaggacatttcaagaagaacaaacttagtaggaacaactcaaaccctaatactaccggtggaggaggaggcggagggtcctcgtcatcggccggaacagctaatgatagtcctcctttgtctccggctgatcggattgaacatcaaagaagaaaagtcaagctactatctatgcttgaagaggtggaccgacggtacaaccactactgcgaacaaatgcaaatggtagtgaactcattcgaccaagtaatgggttacggcgcggcggttccgtacacgacattagctcaaaaggcaatgtctaggcatttccggtgtttgaaagacgcggtagcggttcagcttaaacgcagctgtgagcttctaggggataaagaggcggcaggggctgcatcctcggggttaaccaaaggggaaacgccgcgattgcgtttgctagagcagagtttgcgtcagcaacgagcgtttcatcatatgggtatgatggagcaagaggcatggagaccgcaacgtggtttgcctgaacgctccgttaatatccttagagcttggctattcgagcattttcttaatccgtacccaagcgatgctgataagcacctcttagcacgacagactggtttatccagaaatcaggtgtcaaattggttcataaatgctagggttcgcctatggaaaccaatggtggaagagatgtatcaacaagaagcaaaagaaagagaagaagcagaagaagaaaatgaaaatcaacaacaacaaagaagacagcaacaaacaaacaacaacgacacgaaacccaacaacaatgaaaacaacttcactgtcataaccgcacaaactccaacgacgatgacatcgacacatcacgaaaacgactcttcattcctctcttccgtcgccgccgcttctcacggcggttcagacgcgttcaccgtcgccacgtgtcagcaagacgtcagtgacttccacgtcgacggagatggtgtgaacgtcataagattcgggaccaaacagactggtgacgtgtctcttacgcttggtctacgccactctggcaatattcctgataagaacacttctttctccgttagagactttggagatttttagtcttctttgtttctcaatttattcatc

SEQ ID NO: 2482 - protein, 627 aa, Arabidopsis thaliana
  G965
MGLATTTSSMSQDYHHHQGIFSFSNGFHRSSSTTHQEEVDESAVVSGAQIPVYETAGMLSEMFAYPGGGGGGSGGEILDQSTKQLLEQQNRHNNNNNSTLHMLLPNHHQGFAFTDENTMQPQQQQHFTWPSSSSDHHQNRDMIGTVHVEGGKGLSLSLSSSLAAAKAEEYRSIYCAAVDGTSSSSNASAHHHQFNQFKNLLLENSSSQHHHHQVVGHFGSSSSSPMAASSSIGGIYTLRNSKYTKPAQELLEEFCSVGRGHFKKNKLSRNNSNPNTTGGGGGGGSSSSAGTANDSPPLSPADRIEHQRRKVKLLSMLEEVDRRYNHYCEQMQMVVNSFDQVMGYGAAVPYTTLAQKAMSRHFRCLKDAVAVQLKRSCELLGDKEAAGAASSGLTKGETPRLRLLEQSLRQQRAFHHMGMMEQEAWRPQRGLPERSVNILRAWLFEHFLNPYPSDADKHLLARQTGLSRNQVSNWFINARVRLWKPMVEEMYQQEAKEREEAEEENENQQQQRRQQQTNNNDTKPNNNENNFTVITAQTPTTMTSTHHENDSSFLSSVAAASHGGSDAFTVATCQQDVSDFHVDGDGVNVIRFGTKQTGDVSLTLGLRHSGNIPDKNTSFSVRDFGDF

SEQ ID NO: 2483 - DNA, 833 bp, Arabidopsis thaliana
  G977
  misc_feature (810)..(810): n is a, c, g, or t
caccaaactcacctgaaaccctatttccatttaccattcacactaatggcacgaccacaacaacgctttcgaggcgttagacagaggcattggggctcttgggtctccgaaattcgtcaccctctcttgaaaacaagaatctggctagggacgtttgagacagcggaggatgcagcaagggcctacgacgaggcggctaggctaatgtgtggcccgagagctcgtactaatttcccatacaaccctaatgccattcctacttcctcttccaagcttctatcagcaactcttaccgctaaactccacaaatgctacatggcttctcttcaaatgaccaagcaaacgcaaacacaaacgcaaacgcagaccgcaagatcacaatccgcggacagtgacggtgtgacggctaacgaaagtcatttgaacagaggagtaacggagacgacagagatcaagtgggaagatggaaatgcgaatatgcaacagaattttaggccattggaggaagatcatatcgagcaaatgattgaggagctgcttcactacggttccattgagctttgctctgttttaccaactcagacgctgtgagaaatggccttgtcgttttagcgtattcttttcatttttatttttgtttccacaaaaacggcgtcgtaagtgatgagagtagtagtgagagaaggctaatttcaagacattttgatctgaattggcctcttttgaaacactgattctagtttctataagagcaatcgatcatatgctatgttatgtatagtattataaaaaaatgttattttctgattnaaaaaaaaaaaaaaaaaaaaaaa

SEQ ID NO: 2484 - protein, 181 aa, Arabidopsis thaliana
  G977
MARPQQRFRGVRQRHWGSWVSEIRHPLLKTRIWLGTFETAEDAARAYDEAARLMCGPRARTNFPYNPNAIPTSSSKLLSATLTAKLHKCYMASLQMTKQTQTQTQTQTARSQSADSDGVTANESHLNRGVTETTEIKWEDGNANMQQNFRPLEEDHIEQMIEELLHYGSIELCSVLPTQTL

SEQ ID NO: 2485 - DNA, 789 bp, Arabidopsis thaliana
  G991
gaaaaatggaagaagaaaagagattggagctaaggctagctcctccttgtcaccaattcacttccaacaacaacatcaatggatctaaacaaaaaagctcgaccaaagaaacatcattcctttccaataacagggttgaggtagctccagtggtgggatggccgccggtgagatcatcccggagaaacctaacggcacaactaaaggaggagatgaagaagaaggagagtgatgaagagaaggaattgtacgttaagatcaacatggaaggagttccaataggaagaaaagtcaacctttcagcttataacaactaccaacagctttcacatgccgttgaccaactcttctctaagaaagattcgtgggatctaaacagacaatacactttggtctacgaagacactgaaggagataaagttctggtcggggatgttccttgggagatgtttgtatctactgtaaagaggttgcatgttttaaagacctcccacgccttctcactctcacctagaaaacatggcaaggaatagagagaggttggccaaaatcatcagttcgatggtttgtttttaatgtaatttttgtggaaactaatggggtttggctttgatttactggttttctttttcacttatgtactaggtttttgcttgctatgttatttcttgttttggttgtaaatatgctgttcgtttaagaaatcgggggttagtatgttatcgtgtgtataaaaatagtgtaagcacgtaagttgattacaaaaaaaaaaaaaaaaaaaaaaaaaaa

SEQ ID NO: 2486 - protein, 175 aa, Arabidopsis thaliana
  G991
MEEEKRLELRLAPPCHQFTSNNNINGSKQKSSTKETSFLSNNRVEVAPVVGWPPVRSSRRNLTAQLKEEMKKKESDEEKELYVKINMEGVPIGRKVNLSAYNNYQQLSHAVDQLFSKKDSWDLNRQYTLVYEDTEGDKVLVGDVPWEMFVSTVKRLHVLKTSHAFSLSPRKHGKE

SEQ ID NO: 2487 - DNA, 1095 bp, Arabidopsis thaliana
  G994
tgtatatatagttagttagttgagataaacttggttaccacttttgtgtggtctttctttttctttttctccattttccatttatcgaccccttgggtgtagctaattactttcgcgattttcaaatccaataaagttttaatttgatgaagctttttttaaaccatataatataaataatgggtggtcgtaaaccatgttgtgatgaggttggattaagaaagggtccatggacagtggaagaagatgggaaactagttgatttcttaagggcacgtggcaactgcggtggtggtggaggaggatggtgctggagagacgtgccaaaactggcggggctaaggaggtgtggcaaaagttgccgtctccggtggactaattatctccggccagatctcaagagaggtctttttactgaagaagaaatccaactagtcattgatcttcatgctcgccttggcaatagatggtcgaagattgcagtggagttaccaggaagaacagacaacgatatcaaaaattattggaacactcatataaagaggaagcttataagaatgggtattgatccaaacacacatcgtcgatttgaccaacaaaaagtcaacgaggaggaaacgatattggtcaacgatccaaagcctctgtctgagaccgaggtatctgttgctttgaagaatgacacgtcagcagtgttatcaggaaatctaaaccaattggctgacgtggacggtgatgatcagccgtggagctttctaatggaaaatgacgaaggaggaggtggcgacgccgccggagagcttacgatgctattgtccggtgacattacgtcatcatgttcttcttcgtcatctttgtggatgaagtatggagaattcggatacgaagatttagaacttggatgtttcgatgtttagagattcaagtatgtttaattaggccgtaggttgattaatcataaggttcattgacttcattctagaattgtgtagttggaccagtataaagaatcaaagttatgaaacattgtaatttgatttccaaattaatctaatgaataaatgtgctttgcaaaaaaaaaaaaaaaaaaaaaaa

SEQ ID NO: 2488 - protein, 245 aa, Arabidopsis thaliana
  G994
MGGRKPCCDEVGLRKGPWTVEEDGKLVDFLRARGNCGGGGGGWCWRDVPKLAGLRRCGKSCRLRWTNYLRPDLKRGLFTEEEIQLVIDLHARLGNRWSKIAVELPGRTDNDIKNYWNTHIKRKLIRMGIDPNTHRRFDQQKVNEEETILVNDPKPLSETEVSVALKNDTSAVLSGNLNQLADVDGDDQPWSFLMENDEGGGGDAAGELTMLLSGDITSSCSSSSSLWMKYGEFGYEDLELGCFDV

SEQ ID NO: 2489 - DNA, 1082 bp, Arabidopsis thaliana
  G996
cgatcgatcttgaattgattctttgtagtattttatttacatatatatatagatgggaagacattcatgttgttacaaacagaaactgaggaaaggactttggtctcctgaagaagatgagaagcttcttcgttacatcactaagtatggtcatggttgctggagctctgtccctaaacaagctggtttacagagatgtggaaaaagttgtagattaagatggataaattatttaagaccagatttgaagagaggagcattttctcaagatgaagaaaatctcattattgaacttcatgccgttcttggcaatagatggtctcagatagctgcacagcttcctggaagaaccgacaatgaaatcaagaatctttggaattcttgtttgaagaagaaattgaggctgagaggaattgacccggttacacacaagctcttaaccgaaatcgaaaccggtacagatgacaaaacaaaaccggttgagaagagtcaacagacctacctcgttgagactgatggctcctctagtaccactacttgtagtactaaccaaaacaacaacactgatcatctttataccggaaatttcggttttcaacggttaagtctagaaaacggttcaagaatcgcagccggttctgacctcggtatctggattccccaaaccggaagaaaccatcatcatcatgtcgatgaaaccatccctagtgcagtggtactacccggttcaatgttctcatccggtttaaccggttatagatcctccaatctcggtttaattgaattggaaaactcattctcaaccgggccaatgatgacagagcatcagcaaattcaagagagtaactacaacaattcaacattctttggaaatgggaatctgaattggggattaacaatggaggaaaatcaaaatccattcacaatatcgaatcattcaaattcgtccttatacagtgatataaaatcagagaccaatttttttggcacagaggctacaaatgttggtatgtggccatgtaaccagcttcagcctcagcaacatgcatatggccatatataaatcttcttgtatattataa

SEQ ID NO: 2490 - protein, 336 aa, Arabidopsis thaliana
  G996
MGRHSCCYKQKLRKGLWSPEEDEKLLRYITKYGHGCWSSVPKQAGLQRCGKSCRLRWINYLRPDLKRGAFSQDEENLIIELHAVLGNRWSQIAAQLPGRTDNEIKNLWNSCLKKKLRLRGIDPVTHKLLTEIETGTDDKTKPVEKSQQTYLVETDGSSSTTTCSTNQNNNTDHLYTGNFGFQRLSLENGSRIAAGSDLGIWIPQTGRNHHHHVDETIPSAVVLPGSMFSSGLTGYRSSNLGLIELENSFSTGPMMTEHQQIQESNYNNSTFFGNGNLNWGLTMEENQNPFTISNHSNSSLYSDIKSETNFFGTEATNVGMWPCNQLQPQQHAYGHI

SEQ ID NO: 2491 - DNA, 954 bp, Arabidopsis thaliana
  G1000
atgggaagacctccttgttgtgacaagtccaatgtcaagaaaggtctctggaccgaggaagaagacgctaagatccttgcttatgttgctatccatggtgtaggaaactggagcttgatccccaaaaaagcaggtctgaatcgatgtggaaagagctgtagactaagatggactaattacttaagacctgaccttaaacatgacagcttctctacccaagaagaagagcttatcattgagtgtcatagagccattggcagcaggtggtcttccattgcacgaaagcttccaggaagaacggataatgatgtgaagaatcactggaacacaaagctgaagaagaagctgatgaaaatggggatagacccggtgactcataaaccggtttctcaactccttgcagaattcagaaacattagcggccatggaaatgcatccttcaaaacagaaccatctaacaactctatactcacacaatccaactcagcttgggaaatgatgagaaacacaacaacaaaccatgagagttattacaccaactctccaatgatgtttacaaattcctctgagtaccaaactactccatttcatttctatagccatccaaatcatctgctcaatggaaccacatcttcatgctcttcctcatcatcttctactagtatcactcagccaaaccaagtacctcaaacaccggttactaacttctactggagcgatttccttctctcggacccggttcctcaagtagtgggatcctcagctactagcgacctcacttttacgcagaacgaacatcatttcaacatcgaagccgaatacatctctcaaaacatcgattcaaaggcctcgggaacatgtcattccgcgagttccttcgttgacgaaatactagataaagaccaagagatgttgtcacagtttcctcaactcttgaatgatttcgattattag

SEQ ID NO: 2492 - protein, 317 aa, Arabidopsis thaliana
  G1000
MGRPPCCDKSNVKKGLWTEEEDAKILAYVAIHGVGNWSLIPKKAGLNRCGKSCRLRWTNYLRPDLKHDSFSTQEEELIIECHRAIGSRWSSIARKLPGRTDNDVKNHWNTKLKKKLMKMGIDPVTHKPVSQLLAEFRNISGHGNASFKTEPSNNSILTQSNSAWEMMRNTTTNHESYYTNSPMMFTNSSEYQTTPFHFYSHPNHLLNGTTSSCSSSSSSTSITQPNQVPQTPVTNFYWSDFLLSDPVPQVVGSSATSDLTFTQNEHHFNIEAEYISQNIDSKASGTCHSASSFVDEILDKDQEMLSQFPQLLNDFDY

SEQ ID NO: 2493 - DNA, 923 bp, Arabidopsis thaliana
  G1007
attccttcttgcctaggaactaattgttgcacacttcggtacacaattttttgagcacttcgacatcaaaacgagagagaaaagaatggtggattctcatggctccgacacggaatgttcctccaagaagaaaaaggagaaaacgaaagaaaagggggtatatcgtggggctcgcatgaggagctgggggaaatgggtctcggagattcgggagccccgtaagaaatcaagaatctggctcgggactttccccacggcggagatggcagcgcgtgcccatgatgttgcggcattgagtatcaaaggaagttccgcaatccttaacttccctgagctcgcggattttctgccaagaccagtctcgctcagccaacaggatatccaggccgcagccgccgaagccgctcttatggatttcaaaactgtaccattccatcttcaggatgactcaacgccgttgcaaactaggtgtgatactgagaagatcgaaaagtggtcatcctcatcgtcctcagcctcatcctcatcctcatcttcgtcctcgtcctcatcatctatgctttcgggggagctaggagatattgtggagttgccgagtcttgaaaacaatgtaaaatacgattgtgcgctgtatgactcgttggaggggctggtgtcgatgcccccatggttagatgctaccgaaaatgattttaggtatggagatgattcggtactgttggacccatgtctcaaagaaagctttttgtggaattatgagtaaggtttttttttggaaagaaatgtggttttttgtttcctcctctcttttatactttcgatctttttttctaagcatatatatcttctacatatgtaatacttttccattagtaaacaatgattcggtttcgggtacaaaaaaaaaaaaaaaaaaaaaaaaa

SEQ ID NO: 2494 - protein, 225 aa, Arabidopsis thaliana
  G1007
MVDSHGSDTECSSKKKKEKTKEKGVYRGARMRSWGKWVSEIREPRKKSRIWLGTFPTAEMAARAHDVAALSIKGSSAILNFPELADFLPRPVSLSQQDIQAAAAEAALMDFKTVPFHLQDDSTPLQTRCDTEKIEKWSSSSSSASSSSSSSSSSSSSMLSGELGDIVELPSLENNVKYDCALYDSLEGLVSMPPWLDATENDFRYGDDSVLLDPCLKESFLWNYE

SEQ ID NO: 2495 - DNA, 2052 bp, Arabidopsis thaliana
  G1009
  misc_feature (2033)..(2033): n is a, c, g, or t
aaaaaaaaaaaaaacctattcccaaagatgaagaacaataacaacaaatcttcttcttcttctagctatgattcttctttgtctccttcttcttcatcctcctcccaccagaactggctctctttctctctctccaacaataacaacaacttcaattcttcctcaaaccctaatctcacttcctccacatcagatcatcatcatcctcacccttctcacctctctctctttcaagctttctccacttctccagtcgaacggcaagatgggtcaccgggagtttcacccagcgatgccacggcggttctttccgtataccccggcggtcctaaacttgagaacttcctcggcggaggagcctcaacgacgacaacaagaccaatgcaacaagtgcaatctcttggcggcgttgtcttctcttccgacctacagccaccgcttcatcctccgtccgccgccgagatctacgactctgagctcaagtcaatagccgctagcttcctaggaaactactccggtggacactcgtcggaggtctctagcgtacataaacaacaaccgaatcctctagctgtctcagaggcttcgcctactccgaagaagaacgtagagagttttggacaacgtacctcgatttatagaggagtcacaagacatagatggactggaagatacgaagctcatctatgggataatagttgccgaagagaaggccaaagcagaaaaggaagacaagtttatttaggtggttatgataaggaagataaagcagctagagcttacgaccttgcagctcttaagtattggggtcctacaactacgactaatttcccgatatcaaattacgaatctgaacttgaagaaatgaaacacatgactcgacaagagttcgttgcttctttaagacggaaaagcagtggattctctaggggtgcctccatgtacagaggcgtcactagacatcatcagcatggtcgatggcaggcacgaattggaagagttgcaggcaacaaagacctttatcttggcacatttagcactcaagaggaagctgcagaagcttatgatatagcagcgatcaaattccgcggtctaaatgcagtcaccaatttcgacatcagtcgatatgatgtcaaatcaattgctagctgtaatctccctgtgggtggactaatgcctaaaccttctccagcaaccgcagcggctgacaaaaccgttgatctttctccatccgactctccatctctaaccacaccgtccctcacgttcaatgtggcaacaccggtcaatgaccatggaggaactttttaccacactggtataccaatcaaaccagacccggctgatcattattggtccaacatctttggattccaggcaaacccgaaagcagaaatgcgaccattagcaaactttgggtcggatcttcataacccttctcctggttatgctataatgccggtaatgcaggaaggtgaaaacaactttggtggtagttttgttgggtctgatgggtataacaatcattccgctgcatcgaacccggtctcagcaattccgctgtcctcgacaactacaatgagtaacggtaacgaagggtatggtggaaacataaactggattaataacaacatttcaagttcttaccaaactgcaaaatcaaatctctctgttttgcacacaccggtttttgggttggaatgagtattcacatcttagtgagaactaaaataaatatgtaggaaaaaaataaggctctgtttgaagaaatcagatattttcttcttagattatttaagtagtttaaaaaaaatattttttaagtgtttcacttttacgtttgtctgctgaccacgaattttgctggatctgacagtactaactctttgtttaatgaccttatgggttccttttttactttccagaacttttatttacttttttcttcatttttcttcattttttttgttgtgggacaatatgaatgattgaagatggaaactgcttgcatgtgaataaacgaaaatcaaacnatcttcggtaacttaaaaa

SEQ ID NO: 2496 - protein, 558 aa, Arabidopsis thaliana
  G1009
MKNNNNKSSSSSSYDSSLSPSSSSSSHQNWLSFSLSNNNNNFNSSSNPNLTSSTSDHHHPHPSHLSLFQAFSTSPVERQDGSPGVSPSDATAVLSVYPGGPKLENFLGGGASTTTTRPMQQVQSLGGVVFSSDLQPPLHPPSAAEIYDSELKSIAASFLGNYSGGHSSEVSSVHKQQPNPLAVSEASPTPKKNVESFGQRTSIYRGVTRHRWTGRYEAHLWDNSCRREGQSRKGRQVYLGGYDKEDKAARAYDLAALKYWGPTTTTNFPISNYESELEEMKHMTRQEFVASLRRKSSGFSRGASMYRGVTRHHQHGRWQARIGRVAGNKDLYLGTFSTQEEAAEAYDIAAIKFRGLNAVTNFDISRYDVKSIASCNLPVGGLMPKPSPATAAADKTVDLSPSDSPSLTTPSLTFNVATPVNDHGGTFYHTGIPIKPDPADHYWSNIFGFQANPKAEMRPLANFGSDLHNPSPGYAIMPVMQEGENNFGGSFVGSDGYNNHSAASNPVSAIPLSSTTTMSNGNEGYGGNINWINNNISSSYQTAKSNLSVLHTPVFGLE

SEQ ID NO: 2497 - DNA, 1368 bp, Arabidopsis thaliana
  G1010
attcttcttctaaaaaatcttgacaactttttgtttttgttttctttctctgaattttttaaaagagagagagctatgtagctatgaaacagtaagagatatagatatagagagacagagaaagatgatgatcagtgaagttaggctaaacccactttctatttatgtataattaggtcaatcacatcaccaatctcctcctccaattctcctcctctccttccaaattctagggttttgcttgtatctcaccccctttctcaattccctagggaaactgtgaatttcatcaaattccattattttttggtcacacccttaaagagatctgagagttctaaagatgatgacagatttatctctcacgagagatgaagatgaagaagaagcaaagcccttagcagaagaagaaggagcgcgtgaagtagcagacagagagcacatgttcgacaaagttgtgactccaagtgatgtcggaaaactaaaccgacttgtgatcccaaagcaacacgcagagagattcttccctttagattcatcttcaaacgagaaaggtttgcttttaaacttcgaagatctcactggcaaatcttggaggttccgttactcttactggaacagtagtcaaagctatgtcatgactaaaggttggagcagattcgttaaagacaaaaagcttgacgccggagatattgtctctttccaaagatgtgtcggagattcaggaagagatagccgtttgtttattgattggaggagaagacctaaagtccctgaccatcctcatttcgccgccggagctatgttccctaggttttacagctttccttcgaccaattacagtctttataatcatcagcagcaacgtcatcatcacagtggtggtggttataattatcatcaaattccgagagaatttggttatggttacttcgttaggtcagtggatcagaggaacaatcctgcggctgcggtggctgatccgttggtgattgaatctgtgccggtgatgatgcacgggagagctaatcaggaacttgttggaacggccgggaagagactgaggctttttggagttgatatggaatgcggcgagagcggaatgaccaacagtacggaggaggaatcatcatcttccggtggaagtttgccacgtggaggcggtggtggtgcttcatcttcctctttctttcagctgagacttggaagcagcagtgaagatgatcacttcactaagaaaggaaagtcttcattgtcttttgatttggatcaataataatgatgatgatgaaattagttggtattttaagaaaaaaaacatacatatataattctatatatatgacaacataatgcattgatttcctt

SEQ ID NO: 2498 - protein, 310 aa, Arabidopsis thaliana
  G1010
MMTDLSLTRDEDEEEAKPLAEEEGAREVADREHMFDKVVTPSDVGKLNRLVIPKQHAERFFPLDSSSNEKGLLLNFEDLTGKSWRFRYSYWNSSQSYVMTKGWSRFVKDKKLDAGDIVSFQRCVGDSGRDSRLFIDWRRRPKVPDHPHFAAGAMFPRFYSFPSTNYSLYNHQQQRHHHSGGGYNYHQIPREFGYGYFVRSVDQRNNPAAAVADPLVIESVPVMMHGRANQELVGTAGKRLRLFGVDMECGESGMTNSTEEESSSSGGSLPRGGGGGASSSSFFQLRLGSSSEDDHFTKKGKSSLSFDLDQ

SEQ ID NO: 2499 - DNA, 476 bp, Arabidopsis thaliana
  G1012
aacacacaattcgttgattcatcatatctcctcttcattaatgaatggcctcgtcgactcttctcgagataagaagatgaaaaatccgcgattttcgtttcgcacaaagagtgatgcagatattctcgatgatggttatcgatggagaaagtacggtcagaaatccgtcaagaacagcttgtatcccaggagctattatagatgcacacaacacatgtgtaacgtgaagaagcaagttcagaggctgtcgaaggagacgagcattgtggagacaacttatgaaggaatccataaccatccttgtgaggagctcatgcaaaccctaactcctcttcttcatcaattgcagttcctctctaagttcacctaattatgtttgtatatatattaacgttctaagagcatctccaatggaagtatctcaatgagatacctaacaaaagaaaaaaaatttaaaaaaaaaaaaaaaaaaaaaa

SEQ ID NO: 2500 - protein, 109 aa, Arabidopsis thaliana
  G1012
MNGLVDSSRDKKMKNPRFSFRTKSDADILDDGYRWRKYGQKSVKNSLYPRSYYRCTQHMCNVKKQVQRLSKETSIVETTYEGIHNHPCEELMQTLTPLLHQLQFLSKFT

SEQ ID NO: 2501 - DNA, 1257 bp, Arabidopsis thaliana
  G1014
cacaaaccacagtctctctttctctctctatctatcttctctttctctctctatctctatcactgaaacccaaagagatccaccatttgttcttttttccttcacacagagaactgttttcttccacacttcctttttactaggcagtgttaaccaattgagagagaaaaatgatggttgatgaaaatgtggaaaccaaggcctctactttagtggcaagtgttgatcatgggtttggatccgggtcgggtcatgatcatcatgggttatcggcgtctgtgcctcttcttggtgttaactggaagaagagaaggatgcctagacagagacgatcttcttcttcctttaaccttctctctttccctcctcctatgcctcctatttcccacgtgccaactcctctccccgcacgtaaaattgacccaagaaagctaagattcctcttccaaaaggaactcaagaacagtgacgtcagctctctccgacgtatgatactcccgaagaaagccgcggaggctcacttgccggcacttgaatgcaaggaagggattcctataagaatggaagatttggacggttttcacgtttggaccttcaagtataggtactggccaaacaacaatagcagaatgtacgtgctagaaaacacaggcgattttgtgaatgctcatggtctgcagctaggtgacttcatcatggtttaccaagatctctactcaaacaattacgttatacaagcaagaaaagcatcggaagaagaagaagtagacgtaatcaatcttgaagaagacgacgtttacacaaacttaacaaggatcgaaaacactgtggttaacgatcttctcctccaagattttaatcatcacaacaacaacaacaacaacaacagcaacagcaacagcaacaaatgttcttactattatccagtcatagatgatgtcaccacaaacacagagtcttttgtctacgacacgacggctcttacctccaacgatactcctctcgattttttgggtggacatacgacgactactaataattattactccaagttcggaacattcgatggtttgggctccgttgagaatatctctctcgatgacttctactagataatcaatcgatgggctcatggtattcttgatggtgatcagctatttaatatccttataatatatataagaattaaatgcaatttgcatatatattatcaagtgttgtaatataacattacagtttaaaaaaaaaaaaaaaaaa

SEQ ID NO: 2502 - protein, 312 aa, Arabidopsis thaliana
  G1014
MVDENVETKASTLVASVDHGFGSGSGHDHHGLSASVPLLGVNWKKRRMPRQRRSSSSFNLLSFPPPMPPISHVPTPLPARKIDPRKLRFLFQKELKNSDVSSLRRMILPKKAAEAHLPALECKEGIPIRMEDLDGFHVWTFKYRYWPNNNSRMYVLENTGDFVNAHGLQLGDFIMVYQDLYSNNYVIQARKASEEEEVDVINLEEDDVYTNLTRIENTVVNDLLLQDFNHHNNNNNNNSNSNSNKCSYYYPVIDDVTTNTESFVYDTTALTSNDTPLDFLGGHTTTTNNYYSKFGTFDGLGSVENISLDDFY

SEQ ID NO: 2503 - DNA, 813 bp, Arabidopsis thaliana
  G1020
ctgttcacaagaaagctccccaaaaggagcgttgctttactctcctataaaaagaagctcttctacttcttctcgttaccacaaaactctttcaccgatcttctcgttccattcttcttcctaattacaccatgcccaacatcaccatgggtttgaaacccgacccggttgctccaacgaacccgactcatcatgagagtaatgctgccaaagagattcgttacagaggcgttaggaaacgtccatggggaagatacgccgctgagatccgagatccggttaagaaaactcgagtctggctcggtacgttcgacaccgctcagcaggcggcgcgtgcttacgacgcagccgcgcgtgactttcgtggtgttaaggctaagaccaatttcggtgttatcgttggtagtagtcctactcagagtagcaccgtcgtcgactctcccacggcggcacggtttataacacctccgcacctcgagctcagcttaggcggcggcggcgcgtgtcgtcgtaagatcccgcttgtgcatccggtttactactataacatggcgacgtatccaaagatgacgacgtgtggtgtccagagcgagtctgaaacgtcgtcggtcgttgatttcgaaggtggagctgggaagatatctccgccgttagatctggatcttaacttagctcctccggcggaataggccgtgagttttttttttcttatgtcgtttctttagacaaaaaaaaataacgtttcctttttttttctgcctaagaaaaaaatattatccgttttttagaagaaaaaaaaaaaaaaaaaaaaaa

SEQ ID NO: 2504 - protein, 185 aa, Arabidopsis thaliana
  G1020
MPNITMGLKPDPVAPTNPTHHESNAAKEIRYRGVRKRPWGRYAAEIRDPVKKTRVWLGTFDTAQQAARAYDAAARDFRGVKAKTNFGVIVGSSPTQSSTVVDSPTAARFITPPHLELSLGGGGACRRKIPLVHPVYYYNMATYPKMTTCGVQSESETSSVVDFEGGAGKISPPLDLDLNLAPPAE

SEQ ID NO: 2505 - DNA, 1693 bp, Arabidopsis thaliana
  G1023
tcgtcttcttaatcgctttctgctctgtttttctcgttcatcaagctacatctactagctctctcagtgattgatttctcacagtttcatcgatttccatgcgtttaagacctaaaaggacttgttctggggtaaaggacttttcttgttcttgagagagttcattttgaggcttttctgggaattttgagaggttttttagggtttaagggggtttggttttgaatttcgcacaccaagtgttcgataaaatggctgaacgaaagaaacgctcttctattcaaaccaataaacccaacaaaaaacccatgaagaagaaaccttttcagctaaatcacctcccaggtttatctgaagatttgaagactatgagaaaactccgtttcgttgtgaatgatccttacgctactgactactcatcaagcgaagaagaagaaaggagtcagagaaggaaacgttatgtctgtgagatcgatcttcctttcgctcaagctgctactcaagcagaatctgaaagctcatattgtcaggagagtaacaataatggtgtaagcaagactaaaatctcagcttgtagcaaaaaggttttacgcagcaaagcatctccggtcgttggacgttcttctactactgtctcgaagcctgttggtgttaggcagaggaaatggggtaaatgggctgctgagattagacatccaatcaccaaagtaagaacttggttgggtacttacgagacgcttgaacaagcagctgatgcttatgctaccaagaagcttgagtttgatgctctggctgcagccacttctgctgcttcctctgttttgtcaaatgagtctggttctatgatctcagcctcagggtcaagcattgatcttgacaagaagctagttgattcgactcttgatcaacaagctggtgaatcgaagaaagcgagttttgatttcgactttgcagatctacagattcctgaaatgggttgcttcattgatgactcattcatcccaaatgcttgtgagcttgattttctcttaacagaagagaacaacaaccaaatgttggatgattactgtggcatagatgatctggacatcattggtcttgaatgtgacggtccaagcgaacttccagactatgatttctcagatgtggagatcgatcttggtctcattggaaccaccattgacaagtatgctttcgttgatcatatcgcaacaactactcccactcctcttaatatcgcgtgcccataagttttgcagctaggtgttattattagctataggagcaacgtaaaaagctcgttgttactcggttttgtcttaagttattaaagtatagcagaggcagttaatctcaagggaagcaaaaaccctaaagatagaagcagatgcagttttgtgtgttggtgttactaaagaaagttttgttgacataatggttttgatgttgtggagaagatagagaggtgtgatcgaaattgtaaatctcaggtggttttttttgaaggcaattgtttctcatttagggtttttttctatatgaggattgtctttgaaaagcctttagatgttttctaattcgtaagctctctcaatctttgtaagttttgcctgttgagttattgatacatatgtgagacctactttatttgttttgtgctacatacattgttgatggtttcgtcaaaaaaaaa

SEQ ID NO: 2506 - protein, 332 aa, Arabidopsis thaliana
  G1023
MAERKKRSSIQTNKPNKKPMKKKPFQLNHLPGLSEDLKTMRKLRFVVNDPYATDYSSSEEEERSQRRKRYVCEIDLPFAQAATQAESESSYCQESNNNGVSKTKISACSKKVLRSKASPVVGRSSTTVSKPVGVRQRKWGKWAAEIRHPITKVRTWLGTYETLEQAADAYATKKLEFDALAAATSAASSVLSNESGSMISASGSSIDLDKKLVDSTLDQQAGESKKASFDFDFADLQIPEMGCFIDDSFIPNACELDFLLTEENNNQMLDDYCGIDDLDIIGLECDGPSELPDYDFSDVEIDLGLIGTTIDKYAFVDHIATTTPTPLNIACP

SEQ ID NO: 2507 - DNA, 903 bp, Arabidopsis thaliana
  G1035
ccataataatatattaaaactatatactataatctttttacataataaactttgggtcctgcgtcttaatcatagtacttaattttctctgtgtgttttaatatgaataataaaactgaaatgggatcttccacaagtggaaattgctcgtcggtttcaaccactggtttagctaactccggttcagaatctgatctccggcaacgtgatctaatcgacgagcggaagagaaagaggaaacagtcgaacagagaatctgcgaggaggtcgaggatgaggaagcagaagcatttggatgatctcactgctcaggtgactcatctacgtaaagaaaacgctcagatcgtcgccggaatcgccgtcacgacgcagcactacgtcactatcgaggcggagaacgacattctcagagctcaggttcttgaacttaaccaccgtctccaatctcttaacgagatcgttgatttcgtcgaatcttcttcttcaggattcggtatggagaccggtcagggattattcgacggtggattattcgacggcgtgatgaatcctatgaatctagggttttataatcaaccaatcatggcttctgcttctactgctggtgatgttttcaactgttagaaaacttcacatcattatcatcgtgagtgagactaatcatcgcagcaggggtaaaactgtaatttttcttataaattatgtgatgatgctttgtttctttattttataagatggttaattagtgtttaaaactgattgtaatgatagacagtgtaagaaatgtgtgatatcatggagatggtgatgtgagtttggtacaaatattttaagatcttttctttctatatattaaaagtgaagaaataatattttgtcattttcttaaaaaaaaaaaaaaaa

SEQ ID NO: 2508 - protein, 173 aa, Arabidopsis thaliana
  G1035
MNNKTEMGSSTSGNCSSVSTTGLANSGSESDLRQRDLIDERKRKRKQSNRESARRSRMRKQKHLDDLTAQVTHLRKENAQIVAGIAVTTQHYVTIEAENDILRAQVLELNHRLQSLNEIVDFVESSSSGFGMETGQGLFDGGLFDGVMNPMNLGFYNQPIMASASTAGDVFNC

SEQ ID NO: 2509 - DNA, 1722 bp, Arabidopsis thaliana
  G1037
atgactgttgaacaaaatttagaagctttggatcagtttcctgtaggaatgagagttcttgctgttgatgatgaccaaacttgtctcaaaatccttgaatctctccttcgtcactgccaataccatgtaacaacgacgaaccaagcacaaaaggctttagagttattgagagagaacaagaacaagtttgatctggttattagtgatgttgacatgcctgacatggatggtttcaaactccttgagcttgttggtcttgaaatggacctacctgtcataatgttgtctgcgcatagtgatccaaagtatgtgatgaagggagttactcatggtgcttgtgattatctactgaagccggttcgtattgaggagttgaagaacatatggcaacatgtcgtgagaagtagatttgataagaaccgtgggagtaataataatggtgataagagagatggatcaggtaatgaaggtgttgggaattctgatccgaacaatgggaaaggtaatagaaaacgtaaagatcagtataatgaagatgaggatgaggatagagatgataatgatgattcgtgtgctcaaaagaagcaacgtgttgtttggactgttgagctgcataagaaatttgttgcagctgttaaccaattgggatatgagaaggctatgcctaaaaagattttggatctgatgaatgttgagaagctcactagagaaaatgtggccagtcatcttcagaaattccgcctttacttgaagaggatcagtggtgtggctaatcagcaagctattatggcaaactctgagttacattttatgcaaatgaatggacttgatggtttccatcaccgcccaatccctgttggatctggtcagtaccatggtggggctcctgcaatgagatctttccctccaaacgggattcttggcagactcaatagctcttcggggatcggtgtccgcagcctttcttctcctcctgcaggaatgttcttgcaaaaccagaccgatatcggaaagtttcaccatgtctcatcacttcctcttaaccacagtgatggaggaaacatacttcaagggttgccaatgcctttagagttcgaccagcttcagacaaacaacaacaaaagtagaaacatgaacagtaacaagagcattgctgggacctccatggcttttcctagcttctctacgcaacaaaactcgctcatcagtgctcctaataacaatgtcgtggttctagaaggtcacccacaagcaactcctccaggcttcccaggacaccagatcaataaacgtttggagcattggtcaaatgctgtatcctcttcgactcaccctcctcccccggcacataacagtaatagtatcaatcatcagttcgatgtctctccattaccgcattctagacccgaccccttggaatggaacaatgtgtcatcaagctactctataccattctgtgactctgccaatacattgagttctccagccttggatacaacaaatccccgagctttctgtagaaacacggacttcgattcaaacacaaatgtgcaacctggagtcttttatggtccatccacggatgctatggctctgttgagtagtagtaacccgaaagaagggttcgtcgtaggccaacagaagttacagagtggtggattcatggttgcagatgctggttccttagatgatatagtcaactccacgatgaagcaggtgtga

SEQ ID NO: 2510 - protein, 573 aa, Arabidopsis thaliana
  G1037
MTVEQNLEALDQFPVGMRVLAVDDDQTCLKILESLLRHCQYHVTTTNQAQKALELLRENKNKFDLVISDVDMPDMDGFKLLELVGLEMDLPVIMLSAHSDPKYVMKGVTHGACDYLLKPVRIEELKNIWQHVVRSRFDKNRGSNNNGDKRDGSGNEGVGNSDPNNGKGNRKRKDQYNEDEDEDRDDNDDSCAQKKQRVVWTVELHKKFVAAVNQLGYEKAMPKKILDLMNVEKLTRENVASHLQKFRLYLKRISGVANQQAIMANSELHFMQMNGLDGFHHRPIPVGSGQYHGGAPAMRSFPPNGILGRLNSSSGIGVRSLSSPPAGMFLQNQTDIGKFHHVSSLPLNHSDGGNILQGLPMPLEFDQLQTNNNKSRNMNSNKSIAGTSMAFPSFSTQQNSLISAPNNNVVVLEGHPQATPPGFPGHQINKRLEHWSNAVSSSTHPPPPAHNSNSINHQFDVSPLPHSRPDPLEWNNVSSSYSIPFCDSANTLSSPALDTTNPRAFCRNTDFDSNTNVQPGVFYGPSTDAMALLSSSNPKEGFVVGQQKLQSGGFMVADAGSLDDIVNSTMKQV

SEQ ID NO: 2511 - DNA, 2031 bp, Arabidopsis thaliana
  G1038
gctcgttttcaaattaaaaacagggagaaatttggaaattccagtacgacgggagataaaacctaacatacgccatggtgaccgttatctaaactacgccaaaatatttgaagtgtcgtcgtttcataataaaacgcaaacaaaaacccactcccactttctcctttccaaaaaaagaactctcgccactttctctgctcttttctttctctctctctttcttgttttcgccggcgatcatggagaaaagcggcttctctcccgtcggtctaagggttcttgtcgtagacgatgatccaacttggctcaagattctcgagaaaatgctcaagaagtgttcttacgaagtaacgacctgtggattagctagagaggctttgaggttgctgagggagcgtaaagatggatatgatatcgtgatcagcgatgtgaacatgcctgacatggatggtttcaagcttcttgagcatgttggtcttgaattagacctccctgtaataatgatgtcggtggacggcgaaacaagccgagtgatgaagggagtgcacacgggagcttgtgattacctcttgaagccgataagaatgaaggagttaaagattatatggcaacatgttctgagaaagaagcttcaagaagtgagagatatcgaaggctgtggatacgaaggaggagcggattggatcactcgatacgatgaagcacattttcttggaggtggtgaagatgtttcttttgggaaaaagagaaaagactttgactttgagaagaagcttcttcaagatgagagtgatccatcatcttcttcttccaagaaagctagagttgtttggtcttttgagcttcatcataagtttgtcaacgccgttaaccaaatcggatgcgatcacaaagctggtcccaagaagatattggatctcatgaatgttccatggctcactagagaaaatgttgcaagccaccttcagaaatatagactttacctgagcagattagagaaaggaaaggagctcaagtgttattcaggtggcgtgaagaatgcggattcatctccaaaagatgtcgaagtgaattcaggctaccaaagccctgggaggagcagctatgtattctctggaggaaattctctgatccaaaaagcaacagagattgatccaaagccacttgcttcagcttctttgtctgaccccaacaccgatgtgatcatgcctccgaaaacaaaaaagacgcgtataggatttgatcctcccatttcctcctctgcgtttgactctctgcttccttggaatgatgttccagaggtccttgaatcgaagccggttctgtatgagaatagctttctccagcaacaaccattgccaagtcaaagttcctatgttgcaatttctgcaccatctctcatggaggaggaaatgaagcctccttatgagacaccagcaggaggcagtagtgtgaatgcagatgagtttctcatgccacaagacaagatccctactgtaacccttcaagatttggatccctctgccatgaagctgcaggagttcaacacagaaggcgattctgaagaagcttgaactggggaacttccagaatcacatcattctgtttctttagacactgacttagacttgacttggcttcaaggcgagcgtttcttgcaaacaccgactccagtttcaagatacagtagtagcccatcactcctatctgagctcccagcccaccttaattggtatggaaatgagcggctgcctgaccctgacgagtattccttcatggtagaccaaggtttattcatatcttaaccttgttccaataacttcttttcgtatattggttggtgtaatgcagaaagattttgtgggtatacctgaaaataatcttgctttcccaagaaccttccatgatcggatgcattgtacaataatccacgagtgtcgtaggctaattacaccaaacaggttgatgacagtgataaggccacatgtttcacaccgtcgcttaagatctttactgtcacctggaaggaaa

SEQ ID NO: 2512 - protein, 444 aa, Arabidopsis thaliana
  G1038
MEKSGFSPVGLRVLVVDDDPTWLKILEKMLKKCSYEVTTCGLAREALRLLRERKDGYDIVISDVNMPDMDGFKLLEHVGLELDLPVIMMSVDGETSRVMKGVHTGACDYLLKPIRMKELKIIWQHVLRKKLQEVRDIEGCGYEGGADWITRYDEAHFLGGGEDVSFGKKRKDFDFEKKLLQDESDPSSSSSKKARVVWSFELHHKFVNAVNQIGCDHKAGPKKILDLMNVPWLTRENVASHLQKYRLYLSRLEKGKELKCYSGGVKNADSSPKDVEVNSGYQSPGRSSYVFSGGNSLIQKATEIDPKPLASASLSDPNTDVIMPPKTKKTRIGFDPPISSSAFDSLLPWNDVPEVLESKPVLYENSFLQQQPLPSQSSYVAISAPSLMEEEMKPPYETPAGGSSVNADEFLMPQDKIPTVTLQDLDPSAMKLQEFNTEGDSEEA

SEQ ID NO: 2513 - DNA, 567 bp, Arabidopsis thaliana
  G1046
atgattagacatctaaaaccctacatggagtcgtctagtgtccatcgctctcattgtttcgatattcttgatggagtcccactacacgacgatcatttcaactcggcattcctaccaaacactgactttaatgttcatttgcagtcaaacgtatcgacccgcatcaacaatcagtctcacttagacccaaatgcagaaaacattttccataacgaaggtcttgctccagaagaaagaagagcaagaagaatggtctctaaccgggaatctgcaaggaggtcacgtatgcgcaaaaagaagcagatcgaagagctgcaacaacaagttgaacaactcatgatgttgaatcatcacttgtctgagaaagtcatcaacttgttggaaagcaaccatcagatcctacaagagaactcacagctgaaagagaaagtctcttcctttcacttgctcatggcagatgtgctattacccatgagaaatgcagagagcaacatcaatgaccgcaatgtgaattatctaagaggagaaccatcaaaccgtcccaccaacagtccctttggtaagtaa

SEQ ID NO: 2514 - protein, 188 aa, Arabidopsis thaliana
  G1046
MIRHLKPYMESSSVHRSHCFDILDGVPLHDDHFNSAFLPNTDFNVHLQSNVSTRINNQSHLDPNAENIFHNEGLAPEERRARRMVSNRESARRSRMRKKKQIEELQQQVEQLMMLNHHLSEKVINLLESNHQILQENSQLKEKVSSFHLLMADVLLPMRNAESNINDRNVNYLRGEPSNRPTNSPFGK

SEQ ID NO: 2515 - DNA, 1035 bp, Arabidopsis thaliana
  G1048
gaccatggcggaggaatttggaagcatagatttactcggagatgaagatttcttcttcgatttcgatccttcaatcgtaattgattctcttccggcggaggattttcttcagtcttcaccggattcatggatcggagaaatcgagaatcaattgatgaacgatgagaatcatcaagaggagagttttgtggaattggatcagcaatcggtttcagatttcatagcggatctactcgttgattatccaactagcgattctggctccgttgatttggcggctgataaagttctaaccgtcgattctcccgccgccgctgatgattccgggaaggagaattcggatttggttgttgagaagaagtctaatgattctggtagcgagattcatgatgatgatgacgaagaaggagacgatgatgctgtggctaaaaaacgaagaaggagagtaagaaatagagatgcggcggttagatcgagagagaggaagaaggaatatgtacaagatttagagaagaagagtaagtatctcgaaagagaatgcttgagactaggacgtatgcttgagtgcttcgttgctgaaaaccagtctctacgttactgtttgcaaaagggtaatggcaataatactaccatgatgtcgaagcaggagtctgctgtgctcttgttggaatccctgctgttgggttccctgctttggcttctgggagtaaacttcatttgcctattcccttatatgtcccacacaaagtgttgcctcctacgtccagaaccagaaaagctggttctaaacgggctcgggagtagtagcaaaccgtcttataccggcgttagtcggagatgtaagggttcgaggcctaggatgaaataccaaatcttaacccttgcggcgtgacaacgccttttttaactgcttcttttgcgcattttgagttgtagatgagtgtcttttagttttctctctcttgttttgtatttcgctgttgaaagttttctgtctaatatcgataagttaacagtgaaaaaaaaaaaaaaaaa

SEQ ID NO: 2516 - protein, 295 aa, Arabidopsis thaliana
  G1048
MAEEFGSIDLLGDEDFFFDFDPSIVIDSLPAEDFLQSSPDSWIGEIENQLMNDENHQEESFVELDQQSVSDFIADLLVDYPTSDSGSVDLAADKVLTVDSPAAADDSGKENSDLVVEKKSNDSGSEIHDDDDEEGDDDAVAKKRRRRVRNRDAAVRSRERKKEYVQDLEKKSKYLERECLRLGRMLECFVAENQSLRYCLQKGNGNNTTMMSKQESAVLLLESLLLGSLLWLLGVNFICLFPYMSHTKCCLLRPEPEKLVLNGLGSSSKPSYTGVSRRCKGSRPRMKYQILTLAA

SEQ ID NO: 2517 - DNA, 725 bp, Arabidopsis thaliana
  G1049
ctaactttcttcccaagtaaacttcaaaatgcagccgcaaacagacgttttcagcctccataactacctaaactcatcgatactgcagtctccgtatccttctaatttcccgatatctacgccatttccaaccaacggtcaaaacccgtacctcctctacggattccaaagccctacaaacaatccacaatccatgagcctaagcagcaacaactcaacatcagatgaagcagaagagcagcagacgaacaacaatataatcaacgagcggaagcagagaaggatgatttcaaaccgagaatccgcaaggagatcgcgtatgaggaagcaaagacaccttgacgagctttggtcacaagtgatgtggttaaggatcgagaatcatcagttgcttgataagcttaacaatctctctgagtctcacgacaaggttcttcaagagaatgctcagcttaaagaagaaacatttgagcttaagcaagtgatcagcgatatgcaaattcaaagccctttctcttgctttagagacgatataatccccattgaataaagcatttttccccgattcatatttatgaaaattttcttcaagagtatgtttctttgtatgtatatgtggagatgtatttcagggttttgataatatgaccctttacgacgacgtttttagattgtagtaaatttataaactaaagaagattagtgttaatgaagaacaaatataa

SEQ ID NO: 2518 - protein, 173 aa, Arabidopsis thaliana
  G1049
MQPQTDVFSLHNYLNSSILQSPYPSNFPISTPFPTNGQNPYLLYGFQSPTNNPQSMSLSSNNSTSDEAEEQQTNNNIINERKQRRMISNRESARRSRMRKQRHLDELWSQVMWLRIENHQLLDKLNNLSESHDKVLQENAQLKEETFELKQVISDMQIQSPFSCFRDDIIPIE

SEQ ID NO: 2519 - DNA, 1766 bp, Arabidopsis thaliana
  G1050
ttccccatttcagaaaatcaaaatgggtggtggtggtgatacaacagataccaatatgatgcagagagttaattcttcttctggtacatcgtcttcttcgatccctaaacacaatcttcacttgaatcctgctcttatccgctctcaccatcacttccgtcaccctttcaccggagctcctccaccgccgattccacccatttctccttactctcagatcccggcgactttacaacctagacattctcgctctatgtcgcaaccgtcttctttcttctcctttgattcattgccgccgttaaatccttctgctccgtcggtttcggtgtcggtggaggagaaaaccggtgccggatttagtccttcgttgcctccgtcaccgtttacgatgtgtcattcttctagctctaggaacgccggagatggagagaatctacctccgagaaagtcgcataggcgttcgaatagtgatgttacttttgggtttagttcaatgatgtctcagaatcaaaagtctcctcctttgagttctttggagagatcgatctctggtgaagatacatcagattggtctaatttggtgaagaaagaaccgagagaaggcttctacaagggaagaaaaccagaggttgaagcagctatggacgatgttttcacggcttatatgaatcttgataacattgatgtcttgaattcttttggaggtgaagatggcaagaatgggaatgagaatgtggaggagatggagagtagtagaggtagtggtacaaagaagacgaatggtggaagtagtagtgattctgaaggagatagcagtgcgagtgggaatgtgaaggttgcgttgagttcttcttcttcaggcgtgaagagaagagcaggtggagatattgctcctactggtagacattacaggagtgtttctatggacagttgtttcatggggaagttgaatttcggcgacgaatcatcgctaaagcttccgccttcttcatcagctaaagtttccccaaccaattcaggtgaagggaattcaagtgcttatagtgttgaatttggaaacagtgagtttactgcagctgaaatgaagaagattgcagctgatgagaaactcgctgagattgtaatggctgaccctaagcgtgttaaaagaatcttggcgaaccgcgtatctgctgcacgttcaaaggagcggaagacgcgatacatggcagagttggaacacaaggtgcagacacttcagactgaagctactacattatcggctcagctcacacatttgcagagagattctatggggttgacaaaccagaacagtgagctgaagtttcgtcttcaagctatggagcagcaagcacaactccgcgatgctctgtcagagaaactgaatgaagaagtccagcggttgaaactggtgataggggagccgaaccgcaggcaaagtgggagcagcagcagcgaatcaaagatgtcactaaacccggagatgtttcagcagcttagcataagtcagttacaacaccaacagatgcagcattccaatcagtgtagcacaatgaaagcaaagcacacttcaaacgactagggtaagtaaaactgcgatccgcagttgtctagttacatatatgataagaatcttttgtgcagagttctgtttttggaagttttaaagaaacatatataaagattatgtccgggaaatttgatcatatttcctgaaacatacacacatatatatagtggtaatggaggactttctttctggacca

SEQ ID NO: 2520 - protein, 519 aa, Arabidopsis thaliana
  G1050
MGGGGDTTDTNMMQRVNSSSGTSSSSIPKHNLHLNPALIRSHHHFRHPFTGAPPPPIPPISPYSQIPATLQPRHSRSMSQPSSFFSFDSLPPLNPSAPSVSVSVEEKTGAGFSPSLPPSPFTMCHSSSSRNAGDGENLPPRKSHRRSNSDVTFGFSSMMSQNQKSPPLSSLERSISGEDTSDWSNLVKKEPREGFYKGRKPEVEAAMDDVFTAYMNLDNIDVLNSFGGEDGKNGNENVEEMESSRGSGTKKTNGGSSSDSEGDSSASGNVKVALSSSSSGVKRRAGGDIAPTGRHYRSVSMDSCFMGKLNFGDESSLKLPPSSSAKVSPTNSGEGNSSAYSVEFGNSEFTAAEMKKIAADEKLAEIVMADPKRVKRILANRVSAARSKERKTRYMAELEHKVQTLQTEATTLSAQLTHLQRDSMGLTNQNSELKFRLQAMEQQAQLRDALSEKLNEEVQRLKLVIGEPNRRQSGSSSSESKMSLNPEMFQQLSISQLQHQQMQHSNQCSTMKAKHTSND

SEQ ID NO: 2521 - DNA, 549 bp, Arabidopsis thaliana
  G1053
gaaactcttacatactcatataaaccaaactaaaaccatgattccggcagaaatcaacggatatttccaatatctatcaccggaatacaacgtaataaacatgccttcatctccaacctcttccttaaactacctaaacgatttgatcatcaacaacaacaactattcctcatcatccaacagtcaagatctcatgataagcaacaactcaacttccgacgaagatcatcatcaaagcatcatggtactcgacgagaggaaacagagaaggatgctttcgaacagagaatctgcaaggaggtcaaggatgaggaaacagagacatcttgatgaactctggtctcaggtaataaggcttcgcaacgagaacaactgtcttatcgataagctgaaccgcgtatcggagactcaaaattgtgtattgaaggagaactctaaactcaaagaagaagcttctgatctccgacagcttgtttgtgaactgaaatctaacaagaacaacaacaatagttttccaagagagtttgaagataattagtattactcaaa

SEQ ID NO: 2522 - protein, 166 aa, Arabidopsis thaliana
  G1053
MIPAEINGYFQYLSPEYNVINMPSSPTSSLNYLNDLIINNNNYSSSSNSQDLMISNNSTSDEDHHQSIMVLDERKQRRMLSNRESARRSRMRKQRHLDELWSQVIRLRNENNCLIDKLNRVSETQNCVLKENSKLKEEASDLRQLVCELKSNKNNNNSFPREFEDN

SEQ ID NO: 2523 - DNA, 923 bp, Arabidopsis thaliana
  G1056
gctacatatatgggttctattagaggaaacattgaagagcctatatctcagtcattaacgaggcagaactctctctatagcttaaagctccatgaggttcaaacccacttaggaagttctggaaaaccactaggaagcatgaaccttgatgagcttctcaagactgtcttgccaccagctgaggaagggcttgttcgtcagggaagcttgacgttacctcgagatctcagtaaaaagacagttgatgaggtctggagagatatccaacaggacaagaatggaaacggtactagtactactactactcataagcagcctacactcggtgaaataacacttgaggatttgttgttgagagctggtgtagtgactgagacagtagtccctcaagaaaatgttgttaacatagcttcaaatgggcaatgggttgagtatcatcatcagcctcaacaacaacaagggtttatgacatatccggtttgcgagatgcaagatatggtgatgatgggtggattatcggatacaccacaagcgcctgggaggaaaagagtagctggagagattgtggagaagactgttgagaggagacagaagaggatgatcaagaacagagaatctgcagcacgttcacgagctaggaaacaggcttatacacatgaattagagatcaaggtttcaaggttagaagaagaaaacgaaaaacttcggaggctaaaggaggtggagaagatcctaccaagtgaaccaccaccagatcctaagtggaagctccggcgaacaaactctgcttctctctgatcctaaagactcttctttctttcttcttctttgtgttggtttatatcagaccgctttgttctttgtatattgtgtagactttattgactttgaacagcatgtctttataaacatttcttgagtgt

SEQ ID NO: 2524 - protein, 262 aa, Arabidopsis thaliana
  G1056
MGSIRGNIEEPISQSLTRQNSLYSLKLHEVQTHLGSSGKPLGSMNLDELLKTVLPPAEEGLVRQGSLTLPRDLSKKTVDEVWRDIQQDKNGNGTSTTTTHKQPTLGEITLEDLLLRAGVVTETVVPQENVVNIASNGQWVEYHHQPQQQQGFMTYPVCEMQDMVMMGGLSDTPQAPGRKRVAGEIVEKTVERRQKRMIKNRESAARSRARKQAYTHELEIKVSRLEEENEKLRRLKEVEKILPSEPPPDPKWKLRRTNSASL

SEQ ID NO: 2525 - DNA, 1606 bp, Arabidopsis thaliana
  G1068
gagagttgttagctagctcacacgctttcgcttaaaactcaaaaacctgcactttctcgtctattttctcggcattcgtaaaacagaaaagtgggtctccaagaaaattaccctaaattcacaaagattcatacttttctccacctccaatggattccagagagatccaccaccaacaacagcaacaacaacaacaacaacagcagcagcagcaacaacagcaacatctacaacaacagcaacaaccaccgccagggatgttaatgagtcaccacaattcctacaatcgaaaccctaacgccgccgccgctgttttaatgggtcacaacacctccacatctcaagctatgcatcaaagattaccttttggtggttctatgtcaccgcatcagcctcaacaacatcagtatcatcatcctcagcctcagcaacagatagatcagaagactcttgaatctcttggatttcctacttcgcctcttccttctgcttctaattcttacggtggtggaaatgaaggaggtggtggtggtgatagcgccggagctaatgctaactcttccgatccacctgctaaacggaacagaggacgtcctcctggctccggtaagaagcagctcgatgctttaggaggaacaggaggagttgggttcacgcctcatgtcattgaggttaaaacaggagaggacatagctacgaagatattggcgtttacgaaccaagggccacgcgcaatctgtattctctcagctacaggagctgtaactaatgtgatgcttcgtcaagctaacaatagcaatcctactggaactgttaagtatgagggccgatttgaaatcatttctctgtcaggttctttcttgaattctgagagtaatggtactgtgaccaaaactggtaacttgagtgtgtcgctggctggacacgaaggccggattgtgggtggatgtgttgatggaatgctagtagctggatcacaagtccaggtcattgtgggaagctttgtaccagatggaaggaagcagaaacaaagtgcggggcgtgctcagaatactccggagccagcttcagcaccagccaatatgttgagctttggtggtgttggtggaccgggaagccctcgatctcaaggacaacaacactcgagcgagtcatcagaggaaaacgaaagtaattctccgttgcaccgtagaagcaacaacaacaacagcaacaatcatgggatatttggaaactctacacctcaaccgcttcaccaaattcctatgcagatgtaccagaatctctggcctggcaacagtcctcaataaacagatggttcatgggtcaagatttgaccgggtttgcttctctgttccttttgacacatctctccatcagatttatctctataaagtagattgagctctcttactctctcatcttcttctcctttactatttctcttaaatttagctttggttttagataaatagagagagagagacatgttaagtaggtttcaaattcaatcttgtttagtttgtttcttagtagtttcttttgattgtgatgatcataaagacttgttctttttctcctatattcaacgaattatccactttaa

SEQ ID NO: 2526 - protein, 386 aa, Arabidopsis thaliana
  G1068
MDSREIHHQQQQQQQQQQQQQQQQQHLQQQQQPPPGMLMSHHNSYNRNPNAAAAVLMGHNTSTSQAMHQRLPFGGSMSPHQPQQHQYHHPQPQQQIDQKTLESLGFPTSPLPSASNSYGGGNEGGGGGDSAGANANSSDPPAKRNRGRPPGSGKKQLDALGGTGGVGFTPHVIEVKTGEDIATKILAFTNQGPRAICILSATGAVTNVMLRQANNSNPTGTVKYEGRFEIISLSGSFLNSESNGTVTKTGNLSVSLAGHEGRIVGGCVDGMLVAGSQVQVIVGSFVPDGRKQKQSAGRAQNTPEPASAPANMLSFGGVGGPGSPRSQGQQHSSESSEENESNSPLHRRSNNNNSNNHGIFGNSTPQPLHQIPMQMYQNLWPGNSPQ

SEQ ID NO: 2527 - DNA, 1295 bp, Arabidopsis thaliana
  G1070
tcgaccagcttggatttcgttgttcatcattactactctctttcttcttctagctagctagttttgacagcaaaataagaagcaaaaaaaaggtcaactaaaaaagatctgttcttagatcactctcttcttctttttttgatccaattccaccattgaatcatagatcatggatccagtacaatctcatggatcacaaagctctctacctcctcctttccacgcaagagactttcaattacatcttcaacaacagcaacaagagttcttcctccaccatcaccagcaacaaagaaaccaaaccgatggtgaccaacaaggaggatcaggaggaaaccgacaaatcaagatggatcgtgaagagacaagcgacaacatagacaacatagctaacaacagcggtagtgaaggtaaagacatagatatacacggtggttcaggagaaggaggtggtggctccggaggagatcatcagatgacaagaagaccaagaggaagaccagcgggatccaagaacaaaccaaaaccaccgattatcatcacacgggacagcgcaaacgcgcttagaacccacgtgatggagatcggagatggctgcgacttagtcgaaagcgttgccacttttgcacgaagacgccaacgcggcgtttgcgttatgagcggtactggaaatgttactaacgtcactatacgtcagcctggatctcatccttctcctggctcggtagttagtcttcacggaaggttcgagattctatctctctcaggatcttttctccctcctccggctcctcctacagccaccggattgagtgtttacctcgctggaggacaaggacaggtggttggaggaagcgtagttggtccgttgttatgtgctggtcctgtcgttgtcatggctgcgtcttttagcaatgcggcgtacgaaaggttgcctttagaggaagatgagatgcagacgccggttcatggcggaggaggaggaggatcattggagtcgccgccaatgatgggacaacaactgcaacatcagcaacaagctatgtcaggtcatcaagggttaccacctaatcttcttggttcggttcagttgcagcagcaacatgatcagtcttattggtcaacgggacgaccaccgtattgatcaaatatacacacacactcataatcgttgctagctagctaacgatgaatcatgagtttagtggatatatatatgattaaaagaggttagcttatgaacattaataagagtttggattctatcgagcttcattatgtttgggtcatcgttc

SEQ ID NO: 2528 - protein, 324 aa, Arabidopsis thaliana
  G1070
MDPVQSHGSQSSLPPPFHARDFQLHLQQQQQEFFLHHHQQQRNQTDGDQQGGSGGNRQIKMDREETSDNIDNIANNSGSEGKDIDIHGGSGEGGGGSGGDHQMTRRPRGRPAGSKNKPKPPIIITRDSANALRTHVMEIGDGCDLVESVATFARRRQRGVCVMSGTGNVTNVTIRQPGSHPSPGSVVSLHGRFEILSLSGSFLPPPAPPTATGLSVYLAGGQGQVVGGSVVGPLLCAGPVVVMAASFSNAAYERLPLEEDEMQTPVHGGGGGGSLESPPMMGQQLQHQQQAMSGHQGLPPNLLGSVQLQQQHDQSYWSTGRPPY

SEQ ID NO: 2529 - DNA, 1995 bp, Arabidopsis thaliana
  G1079
atgggttgtgctgcttcaagaattgataatgaagaaaaggttttagtgtgtaggcagagaaagaggctaatgaaaaagttattagggttcaggggagaatttgcagatgcacagttggcttatcttagagctttgaggaacactggtgttactcttaggcaattcactgagtctgagaccttggagcttgaaaacactagttatggtttaagtttgcctttgcctccttcgcctcctcctacattgcctccttcacctccaccacctcctccatttagcccggatttgagaaatcctgagactagtcatgacttggctgatgaggaggaagagggtgaaaatgatggtggtaatgatggaagtggtgcagctcctccgcctccattgccgaattcttggaacatttggaacccttttgagtcacttgagctgcatagtcatccaaatggtgacaatgtagttacacaagttgaactgaagaagaaacaacaaattcagcaagctgaagaggaagattgggcggagacgaagtctcaatttgaggaagaagatgagcaacaagaagcaggaggtacttgccttgatttgagtgttcatcaaatagaggctgttagtggctgtaacatgaagaagccacgtcgtctgaagtttaagctgggagaagttatggacggtaactcatctatgacaagctgctccggtaaagatcttgagaaaactcatgtgactgattgtagaatcaggaggaccttagaaggaatcatcagagagttggatgattattttcttaaagcatcgggttgcgagaaggagatagctgtgatagtagacatcaacagtagggatactgttgatcctttcaggtaccaggaaacaagaaggaagagaagcagctcggcaaaggtattcagtgcattgtcatggagttggtcttcaaagtctcttcagttgggcaaagatgctacaacaagcgggactgttgaaccctgtaggcctggagctcactgcagcacacttgagaagctatacacagctgagaagaaactttaccagctagtcagaaacaaagagattgccaaagtggagcatgagaggaagtctgcattactgcaaaagcaagatggggaaacctatgatttgagcaaaatggagaaagcacgcttgtctttggagagtttggaaaccgagatacagcgtctagaagattccataactacaacacgctcatgtttgcttaacttgatcaatgatgagctgtatccgcagctagttgctttaacttcagggctagcacagatgtggaaaacaatgctcaagtgtcatcaagttcaaattcatatatcccagcaactgaaccatcttccggattacccgagtatagatctcagttcggaatacaaacgccaggcggttaatgaactagagaccgaggttacttgctggtacaatagcttttgcaagttagtaaattcccagcgagaatacgtgaaaacactctgtacgtggatccaacttactgatcgcctctctaacgaagacaaccaaagaagtagcttgcctgttgctgctcgtaagctctgcaaagagtggcagcttgaatacaacctgcgtaggaaatgcaataaacttgagaggaggcttgagaaagagctaatttcactggctgagattgaaagaaggctcgaggggattttagcaatggaagaggaggaagtaagctcaacgagtttgggctctaagcatccgttgtcaatcaaacaagccaagatcgaagccttgagaaaacgagtggatattgagaaaactaagtacttaaactcggtcgaggttagtaagagaatgacactagacaacctcaaatcaagccttcccaatgtctttcagatgttgactgctctagctaatgtctttgccaatgggtttgaatccgttaatggccaaaccggtacagatgtttccgacacatcccaacattccgatgaatctcaaccctaa

SEQ ID NO: 2530 - protein, 664 aa, Arabidopsis thaliana
  G1079
MGCAASRIDNEEKVLVCRQRKRLMKKLLGFRGEFADAQLAYLRALRNTGVTLRQFTESETLELENTSYGLSLPLPPSPPPTLPPSPPPPPPFSPDLRNPETSHDLADEEEEGENDGGNDGSGAAPPPPLPNSWNIWNPFESLELHSHPNGDNVVTQVELKKKQQIQQAEEEDWAETKSQFEEEDEQQEAGGTCLDLSVHQIEAVSGCNMKKPRRLKFKLGEVMDGNSSMTSCSGKDLEKTHVTDCRIRRTLEGIIRELDDYFLKASGCEKEIAVIVDINSRDTVDPFRYQETRRKRSSSAKVFSALSWSWSSKSLQLGKDATTSGTVEPCRPGAHCSTLEKLYTAEKKLYQLVRNKEIAKVEHERKSALLQKQDGETYDLSKMEKARLSLESLETEIQRLEDSITTTRSCLLNLINDELYPQLVALTSGLAQMWKTMLKCHQVQIHISQQLNHLPDYPSIDLSSEYKRQAVNELETEVTCWYNSFCKLVNSQREYVKTLCTWIQLTDRLSNEDNQRSSLPVAARKLCKEWQLEYNLRRKCNKLERRLEKELISLAEIERRLEGILAMEEEEVSSTSLGSKHPLSIKQAKIEALRKRVDIEKTKYLNSVEVSKRMTLDNLKSSLPNVFQMLTALANVFANGFESVNGQTGTDVSDTSQHSDESQP

SEQ ID NO: 2531 - DNA, 531 bp, Arabidopsis thaliana
  G1093
atgggttatccggtggggtacactgagctcctcctcccaagaatcttccttcacttactctctctcttaggcttaatacgaacactcatagacacgggttttcggatattgggtctacccgactttctcgaatccgacccggtttcatcgtcatcgtcatggctggaaccaccgtatatgtccacggcggcgcatcatcaccaagaaagctcatttttcttcccagtggcggcgaggctagctggagaaatcttgcccgtcatcagattctcggagctaactcgacccggattcggatccggatccgattgctgcgcggtgtgcctccacgagttcgagaacgatgacgagatccgacggctgacgaattgtcaacacatatttcaccggagctgtttagaccgttggatgatgggttataatcagatgacgtgtccactttgtagaacgccgtttatttctgatgagttacaagttgcttttaaccaacgagtttggtctgaatctgaacttctcgcagaatcaaattag

SEQ ID NO: 2532 - protein, 176 aa, Arabidopsis thaliana
  G1093
MGYPVGYTELLLPRIFLHLLSLLGLIRTLIDTGFRILGLPDFLESDPVSSSSSWLEPPYMSTAAHHHQESSFFFPVAARLAGEILPVIRFSELTRPGFGSGSDCCAVCLHEFENDDEIRRLTNCQHIFHRSCLDRWMMGYNQMTCPLCRTPFISDELQVAFNQRVWSESELLAESN

SEQ ID NO: 2533 - DNA, 1146 bp, Arabidopsis thaliana
  G1095
atggatctaacagaccgtcgtaacccttttaacaatcttgtttttccgccgccgcctccgccgccatccacgaccttcacaagccctatattcccacgaacaagctcttccggcaccaatttccccattctggccatcgcagtgattggaatcttagccactgcgttcttacttgtaagttactacatcttcgtgatcaaatgctgtcttaattggcaccaaatcgacatctttcgccgccgcagacgaagcagtgaccaaaaccctctaatgatttactctcctcatgaggtaaacagaggactagacgaatccgccattagagctatcccagtcttcaaattcaagaagagagacgttgttgcaggagaagaagatcagagtaagaactctcaagaatgctctgtttgtttaaacgagtttcaagaagacgagaagctaaggattattcctaactgctgccacgtgtttcacattgattgcattgatatctggcttcagggcaacgcaaattgtcccttgtgcagaaccagcgtttcttgcgaagcaagtttcactcttgacctaatctctgcaccgagctctcctcgggagaatagccctcattctcggaacaggaatctcgaacccggcctggttctaggaggcgatgatgacttcgtcgtcatagagcttggggccagtaatggtaacaacagagaaagcgtgagaaacatagacttccttacggagcaagaaagggttacctcgaatgaggtctcgaccggaaacagcccgaaatcggtgagtcctttgcctataaagtttggtaatcggggaatgtataagaaagaaaggaaatttcacaaagtgacgagtatgggagacgaatgtatcgatactagaggcaaagatggtcattttggtgaaattcagcccataagaagatcgatctcgatggattcatcagtggatcgtcagctgtacttggcggtccaagaggaaatcagccggagaaacaggcagattccggtagctggagacggtgaagatagtagcagtagtggtggtggtaatagcagagtcatgaagagatgtttcttctcttttggaagtagtagaacttcaaaaagttcttcaatattacctgtttatttggaaccctaa

SEQ ID NO: 2534 - protein, 381 aa, Arabidopsis thaliana
  G1095
MDLTDRRNPFNNLVFPPPPPPPSTTFTSPIFPRTSSSGTNFPILAIAVIGILATAFLLVSYYIFVIKCCLNWHQIDIFRRRRRSSDQNPLMIYSPHEVNRGLDESAIRAIPVFKFKKRDVVAGEEDQSKNSQECSVCLNEFQEDEKLRIIPNCCHVFHIDCIDIWLQGNANCPLCRTSVSCEASFTLDLISAPSSPRENSPHSRNRNLEPGLVLGGDDDFVVIELGASNGNNRESVRNIDFLTEQERVTSNEVSTGNSPKSVSPLPIKFGNRGMYKKERKFHKVTSMGDECIDTRGKDGHFGEIQPIRRSISMDSSVDRQLYLAVQEEISRRNRQIPVAGDGEDSSSSGGGNSRVMKRCFFSFGSSRTSKSSSILPVYLEP

SEQ ID NO: 2535 - DNA, 1407 bp, Arabidopsis thaliana
  G1127
gacagactctctctgtatgtgtgcgagaagcgagaagcgagagagagagagagagagttgttagctcacacgctttctctattttctcggaattcacaaaacagaaagtttcatcctttacgagaattaagccgaaagaaacaatctttgagtttgatttcttcttccttccttctctctctctgctctaatggattccagagacatcccaccgtcacataaccagcttcaaccaccaccgggaatgttaatgtctcattaccgtaaccctaacgccgccgcttcaccattaatggttcccacttccacatctcaaccgattcaacaccctcgtcttccttttggcaatcaacaacaatctcaaacgtttcatcagcagcaacaacaacaaatggatcagaagactcttgaatctcttggatttggtgatggatcaccttcttctcaaccgatgcgattcgggatcgatgatcagaatcagcaactgcaagtgaagaagaagcgaggaaggccgagaaagtatactcctgatggtagcattgctttaggtttagctcctacgtctcctcttctctctgcagcttctaattcttacggtgagggtggtgttggagatagtggtggaaatggaaactctgttgatccacctgttaaacgtaacagaggaaggcctcctggttctagtaagaaacagcttgatgctttaggaggaacttcaggagttgggtttacacctcatgtcattgaagtgaacacaggagaggacatagcgtcaaaggtgatggctttttcggatcaagggtcaagaacaatttgtattctctctgcaagtggtgcagtttctagagtgatgcttcgtcaagcttctcattctagtggaatcgttacttatgagggacgatttgagatcattactctctcaggctcagtcttgaattatgaggtaaatggttccaccaacagaagtggtaacttgagtgtggctttggctggacctgatggcggcatcgtaggtggcagtgtagttggtaatctagtagctgcaacacaagtccaggtgatagtgggaagctttgttgcagaagcaaagaaaccgaaacaaagtagtgttaacattgctcgggggcagaatcctgaaccggcttcagcgccggctaacatgttgaactttggatcagtctctcaaggaccatcgagcgagtcatcagaagagaatgagagcggttctcctgcaatgcaccgtgacaataataatgggatatatggagctcaacaacaacaacaacaacaacctcttcatcctcatcagatgcaaatgtaccaacatctttggtctaatcatggtcaataaaatgaagcggaaattaatttgtttccgttttggttacggttatggtttgatttctt

SEQ ID NO: 2536 - protein, 386 aa, Arabidopsis thaliana
  G1127
MDSRDIPPSHNQLQPPPGMLMSHYRNPNAAASPLMVPTSTSQPIQHPRLPFGNQQQSQTFHQQQQQQMDQKTLESLGFGDGSPSSQPMRFGIDDQNQQLQVKKKRGRPRKYTPDGSIALGLAPTSPLLSAASNSYGEGGVGDSGGNGNSVDPPVKRNRGRPPGSSKKQLDALGGTSGVGFTPHVIEVNTGEDIASKVMAFSDQGSRTICILSASGAVSRVMLRQASHSSGIVTYEGRFEIITLSGSVLNYEVNGSTNRSGNLSVALAGPDGGIVGGSVVGNLVAATQVQVIVGSFVAEAKKPKQSSVNIARGQNPEPASAPANMLNFGSVSQGPSSESSEENESGSPAMHRDNNNGIYGAQQQQQQQPLHPHQMQMYQHLWSNHGQ

SEQ ID NO: 2537 - DNA, 1150 bp, Arabidopsis thaliana
  G1131
tcgactcctctcctgattgcttcaccttcttctttactacaggtttcagctcctcaatgtccatggattgcttaagctacttctttaactacgatcctcctgtccagctccaggattgctttattcccgagatggatatgattatccctgaaaccgatagtttcttcttccaatctcaaccgcaactggagtttcatcagccattgtttcaagaagaagctccttcacagacccactttgaccctttctgcgaccagtttctttctccgcaagaaatctttctccctaaccctaaaaacgaaatcttcaacgaaacacacgacctcgatttctttctccccacgccaaaacgccagagacttgttaactccagctacaattgtaacactcaaaaccatttccagagccgtaacccgaatttcttcgaccctttcggcgacactgatttcgttccagaatcttgtaccttccaggagtttcgagttccggatttctctttagctttcaaggtaggccggggagatcaagatgactcaaagaaaccgacgctttcatctcagagcatcgcggctagagggaggagaagaagaattgcagagaagactcacgagctcggaaaactcatccccggtggcaataaacttaacaccgccgagatgttccaagccgccgctaagtatgtcaagtttttgcagagtcaagttgggattctccaactgatgcagaccacaaagaaggtaataaccaaccccaaataagaactttatcatccaattgaaactctaatcgtgttttctcacaagcttcttaatttgtttacgcagggtagctctaatgtgcaaatggaaactcagtatttgcttgaatcgcaagcaatccaggagaagttatcaacagaggaagtgtgtttggtaccgtgtgaaatggttcaagatctaacaactgaagaaaccatttgcagaaccccgaatatttctcgagaaatcaacaagttactgtctaaacatctggctaactagttttagtttcaagcctgaagttctctatgcctaaatttgtgtctgttatcgttgttttgtcttcttagttagtgttttgtcttgttgatttaggggctaattatcctggttaatctcctcttaactgggaa

SEQ ID NO: 2538 - protein, 233 aa, Arabidopsis thaliana
  G1131
MSMDCLSYFFNYDPPVQLQDCFIPEMDMIIPETDSFFFQSQPQLEFHQPLFQEEAPSQTHFDPFCDQFLSPQEIFLPNPKNEIFNETHDLDFFLPTPKRQRLVNSSYNCNTQNHFQSRNPNFFDPFGDTDFVPESCTFQEFRVPDFSLAFKVGRGDQDDSKKPTLSSQSIAARGRRRRIAEKTHELGKLIPGGNKLNTAEMFQAAAKYVKFLQSQVGILQLMQTTKKVITNPK

SEQ ID NO: 2539 - DNA, 1311 bp, Arabidopsis thaliana
  G1137
tacttcagacttctactcaaaccagtcacgtagttggttggtgacatttcgctgcatttttcaatctgtgattgtttttcgttcgtctttcttttactattttctcgaaaaggacacaagaagtattgcattcactcagttgagcaacttaacaatcgtgttgtactttttgaagttcccttgagctaaactgctaagagcatgcctctggataagaggcaacgggatttgcctctgggcttaagtcctcaagcttgcttcaaggatatagtaggtcggtctgtccttcctagaattcctctccctgagcttgggaaactatatgcagctaagcttcaggctcgctgtttgcagccaccaccattccagtctttgctgtgcagtcatgataaggagtcttatggaaaaagattctcacggtctgacatgcggtcttggtgcgctgctgctactactactactactccacttggagcattagagtcttctcagaaaagacttttgatattcgatcagtcaggagaccagactcgtctattacaatgtccatttcctctacggtttccatctcatgcggctgcagaaccagtgaaactctctgagttacaaggtatagagaaagctttcaaagaagatggtgaagagtttcacaagagtgatggaacagagtcagaaatgcatgaagacactgaggagatcaatgcattgctatattcagatgatgattatgatgatgattgcgagagtgatgatgaagtaatgagcactggtcactctccttatccaaatgaaggagtttgcaacaaaagggaattagaagaaatcgatggtccttgtaaaaggcagaaactactggataaggtcaacaacatcagcgacttatcatcacttgtgggcactgagagctccacacaactcaatggatcttcctttcttaaggacaaaaagctccctgaatcaaaaaccatatcgaccaaagaggacactggttctggtctgagcaacgagcagtcgaagaaagacaagatccgcacagctctgaaaatactcgagagcgtagtccctggtgcaaaaggaaacgaagcgctcttacttctggacgaagcaattgattacctaaagttgctgaaacgagacttaatctccacagaggttaagaaccaaagctccaccactcacaagtcaccaatcttgttgcttaaagagacaacatggggaacaagaaatctgcagacagataaggcgtgaaagattctgacgagttaaaacgtgtgaagtgggtttttgggtacgtatccttgcaccagcttt

SEQ ID NO: 2540 - protein, 348 aa, Arabidopsis thaliana
  G1137
MPLDKRQRDLPLGLSPQACFKDIVGRSVLPRIPLPELGKLYAAKLQARCLQPPPFQSLLCSHDKESYGKRFSRSDMRSWCAAATTTTTPLGALESSQKRLLIFDQSGDQTRLLQCPFPLRFPSHAAAEPVKLSELQGIEKAFKEDGEEFHKSDGTESEMHEDTEEINALLYSDDDYDDDCESDDEVMSTGHSPYPNEGVCNKRELEEIDGPCKRQKLLDKVNNISDLSSLVGTESSTQLNGSSFLKDKKLPESKTISTKEDTGSGLSNEQSKKDKIRTALKILESVVPGAKGNEALLLLDEAIDYLKLLKRDLISTEVKNQSSTTHKSPILLLKETTWGTRNLQTDKA

SEQ ID NO: 2541 - DNA, 1357 bp, Arabidopsis thaliana
  G1145
gtgatttctctctgccatttccttcgatttgatttctgggttctcttcttctcgtctctcttctgcatgtttcgccactctaccttagaaaaaaggttactttcgcctccgatttaggctcgatttgatgaattcgtcgtcgtgtggctatttatcaaattgagcattagggtttctgatttgtgggttcagaattgtttttatctatctgtcttgttgttttttgtccgctacaaaagcctatggattctcagaggggtattgttgaacaagctaaatctcagtccttgaataggcaaagctctctttacagcttaacacttgatgaggttcaaaatcacttggggagttctggtaaagctctgggaagcatgaaccttgatgagcttttgaagagtgtctgttctgttgaagctaatcagccatcgtctatggctgtcaatggtggagcagctgctcaggagggtctttctcgccaggggagtttgactttgcctcgggatctcagcaaaaagactgttgatgaggtttggaaagacattcagcagaataagaatggaggtagtgctcatgagaggagggataagcagcctacacttggggaaatgacgcttgaagacctgttgttgaaagcaggagtggtcactgagactatccctggttcgaaccatgatggtcctgttggtggtggtagtgctggttcaggtgctggtttagggcaaaacattactcaagttggcccatggattcaatatcatcagctcccatcaatgccacagcctcaagcatttatgccctatccggtttcagatatgcaagcaatggtgtctcagtcttctttgatgggtggtttgtcagatacacaaactcctggaaggaagagggtagcttcaggagaagttgtagagaagactgtagagaggaggcagaagagaatgataaagaacagagagtctgctgctcgttcccgagctaggaaacaggcttacactcatgagctagagatcaaagtttcacggttagaagaagaaaacgaaagactcaggaagcaaaaggaggtggaaaaatcctcccaagtgtaccaccgcctgatcccaagcggcagctccgacggacaagctcggctcctttctgatctctaaactctttttgtctttttctttttttctcttctgtgtcggttcacttataaaaaagagaggaaaacagctttgtttctttgtacattccgtagactttcttgacttggagcaattctgttaactttaaaatattctcgagttattgtagtagcagactagcagcagtaatggttttcatgagtccgattgaaattcagagattgaacaggaaaaaa

SEQ ID NO: 2542 - protein, 299 aa, Arabidopsis thaliana
  G1145
MDSQRGIVEQAKSQSLNRQSSLYSLTLDEVQNHLGSSGKALGSMNLDELLKSVCSVEANQPSSMAVNGGAAAQEGLSRQGSLTLPRDLSKKTVDEVWKDIQQNKNGGSAHERRDKQPTLGEMTLEDLLLKAGVVTETIPGSNHDGPVGGGSAGSGAGLGQNITQVGPWIQYHQLPSMPQPQAFMPYPVSDMQAMVSQSSLMGGLSDTQTPGRKRVASGEVVEKTVERRQKRMIKNRESAARSRARKQAYTHELEIKVSRLEEENERLRKQKEVEKSSQVYHRLIPSGSSDGQARLLSDL

SEQ ID NO: 2543 - DNA, 1239 bp, Arabidopsis thaliana
  G1181
ctcgatcttttaacccccattattacatattactccttcctacattattcttcttctgctttcgtgactttcaggggacacttttgtttttataacttacgcttaaaatcctatgaattcgccgccggttgacgcaatgattaccggagaatcatcgtcacaaagatctatcccaacgccgtttctcacaaaaacgtttaacctcgttgaagatagttccatcgacgatgttatctcatggaacgaagatggttcctctttcatcgtatggaatccgacagatttcgctaaagatttgcttcctaaacacttcaaacacaacaatttctctagtttcgttcgtcagctcaacacttacggattcaaaaaagttgtaccggatcgatgggagttttcaaacgatttctttaagagaggagaaaaacgtcttctccgtgagatccaacgtcggaaaataacaacgacgcatcaaacagttgttgctccttcgtcggaacaacgaaaccagacgatggttgtatcaccgtcaaattccggggaagataataataataatcaggtgatgtcttcgtctccgtcgtcgtggtattgtcatcaaacgaagacgactgggaatggtggtttatcagtggagttattggaagagaacgagaagcttcggagtcaaaacattcagctaaaccgtgagcttactcagatgaaatctatctgcgataatatctatagtctcatgtcgaattacgtcggatctcagcccactgatcggagttattctcccggaggtagtagtagtcaaccgatggagtttttaccggcgaagcggttttcggagatggagattgaagaagaagaagaagcgagtccgaggttgtttggtgttccgattgggttaaaacggacgagaagtgaaggtgttcaggtgaagacgacggcggtggttggggaaaattccgatgaggagacgccgtggttgagacattataatcgaaccaatcagagagtttgtaattaaaaacgaacggtttagatttgtggtgtagatatgtgcgcgaagtagacgattacagctttttaagacaagcagagcacgtgtcccatctgtttcaagaagtttctgcaatcttgacttcttcttttaacactttgtgttttttattatttaattaataacaataaatgttctttttcagttttgttttcttcaaaaatagttcggctgtttctagactttcctttttt

SEQ ID NO: 2544 - protein, 299 aa, Arabidopsis thaliana
  G1181
MNSPPVDAMITGESSSQRSIPTPFLTKTFNLVEDSSIDDVISWNEDGSSFIVWNPTDFAKDLLPKHFKHNNFSSFVRQLNTYGFKKVVPDRWEFSNDFFKRGEKRLLREIQRRKITTTHQTVVAPSSEQRNQTMVVSPSNSGEDNNNNQVMSSSPSSWYCHQTKTTGNGGLSVELLEENEKLRSQNIQLNRELTQMKSICDNIYSLMSNYVGSQPTDRSYSPGGSSSQPMEFLPAKRFSEMEIEEEEEASPRLFGVPIGLKRTRSEGVQVKTTAVVGENSDEETPWLRHYNRTNQRVCN

SEQ ID NO: 2545 - DNA, 2324 bp, Arabidopsis thaliana
  G1190
tcctgtcccaaaaccaaaagacttgagagtgtgtctttagagagagatcttctctcttttatcttacgactctcacttcttatctcaaatctacttcaactctatttccagtctccacattttcccacaaatttcaactcttgttctcttcctccaaagtaaaaaacaaatcgttgcaagtgaggtttggttttggtgttatagaattatgaagagcgggaagcaatcttcgcaacctgaaaagggtacttccaggatcttgtcactgactgtcctgtttatcgcattttgcggtttctccttctacctcggtggtatattttgctctgagagagacaagattgtagccaaggatgtcacaaggacgactacaaaggctgtagcttcccctaaagaacctacagctactcctattcaaatcaaatccgtttctttcccggagtgcgggtcagagttccaagattacaccccgtgcaccgatccaaagaggtggaagaagtatggtgtccatcgcttaagtttcttggagcgtcattgtcctccggtatatgaaaagaatgagtgtttgattccaccaccagacgggtataaaccgcctataagatggcccaagagccgagaacagtgttggtacaggaacgtgccttatgattggatcaataagcaaaagtctaaccagcattggcttaagaaagaaggagataagttccatttccctggtggtggtaccatgttccctcgtggagttagtcactatgttgatttgatgcaagatctgattcctgaaatgaaagacggaacagtcaggaccgccattgatactggctgtggggttgcgagctggggaggcgatcttttggaccgtgggatactatcactctctcttgctccaagagataaccatgaagctcaggttcaatttgctcttgaacgtggaattcctgcgattctcgggatcatctctacgcaacgtctcccttttccttcaaatgcatttgatatggctcattgttcaagatgtcttattccctggacagaatttggtggaatctatttacttgagattcaccgtatagttcgacctggaggtttttgggttctttctggtccacctgtgaactataatagacgatggcgtggatggaacacaaccatggaagatcagaaatctgactacaacaagcttcagtcacttctaacctccatgtgtttcaaaaagtacgctcaaaaagatgacatagccgtgtggcagaaactctcagacaaatcttgctatgacaaaatcgctaagaacatggaagcttaccctcccaaatgtgacgacagtatagaacctgattctgcttggtacactccactccgtccttgcgtggttgccccgacacctaaagtcaagaagtctggtctcggatcaatcccaaaatggcccgagaggttacatgtcgcgcccgagagaatcggtgatgttcacggagggagtgcgaacagtttgaaacacgatgatggtaaatggaagaacagagttaagcattacaagaaagttttaccagctcttgggacagacaagataagaaatgttatggatatgaacactgtttatggaggtttctctgcggccctcattgaggatcccatttgggtcatgaacgttgtatcatcgtacagcgcaaattcgcttcctgttgtctttgatcgcggtctcatcgggacttaccacgactggtgcgaagctttctcaacgtatccaagaacatatgatcttcttcacctcgacagtctttttaccttggagagtcacaggtgtgagatgaagtacattttgctagagatggacaggatcttgcggccgagtggatatgttataatccgagaatcgagttatttcatggacgcaatcacaacgttagcgaaagggataaggtggagttgccggagagaggagactgagtatgcagtcaaaagtgagaagattctggtttgccagaaaaagctatggttttcgtcaaaccaaacctcttgatgagaccacctgtatcatagtgtttatcatctcctgtgatgcacactacagagagaaggatctagtcctttgagtccaagatatagctctataaacaatctcctttttttgttctctttaatttcttgggtatttcacggtatagattgatattatatattttttaattatatttttaatatatagatatattagtatgtggtttaaacactattattatcaaggtcttaaagatttgctttgcaagagttaaaaaatgttggagtaaggacctcttgattaataaattgactgacgcagcaaa

SEQ ID NO: 2546 - protein, 603 aa, Arabidopsis thaliana
  G1190
MKSGKQSSQPEKGTSRILSLTVLFIAFCGFSFYLGGIFCSERDKIVAKDVTRTTTKAVASPKEPTATPIQIKSVSFPECGSEFQDYTPCTDPKRWKKYGVHRLSFLERHCPPVYEKNECLIPPPDGYKPPIRWPKSREQCWYRNVPYDWINKQKSNQHWLKKEGDKFHFPGGGTMFPRGVSHYVDLMQDLIPEMKDGTVRTAIDTGCGVASWGGDLLDRGILSLSLAPRDNHEAQVQFALERGIPAILGIISTQRLPFPSNAFDMAHCSRCLIPWTEFGGIYLLEIHRIVRPGGFWVLSGPPVNYNRRWRGWNTTMEDQKSDYNKLQSLLTSMCFKKYAQKDDIAVWQKLSDKSCYDKIAKNMEAYPPKCDDSIEPDSAWYTPLRPCVVAPTPKVKKSGLGSIPKWPERLHVAPERIGDVHGGSANSLKHDDGKWKNRVKHYKKVLPALGTDKIRNVMDMNTVYGGFSAALIEDPIWVMNVVSSYSANSLPVVFDRGLIGTYHDWCEAFSTYPRTYDLLHLDSLFTLESHRCEMKYILLEMDRILRPSGYVIIRESSYFMDAITTLAKGIRWSCRREETEYAVKSEKILVCQKKLWFSSNQTS

SEQ ID NO: 2547 - DNA, 1625 bp, Arabidopsis thaliana
  G1227
tcttccgtgtgttaacagaagtccccacaattgtctgtcttcgctgcgagacaaaactgccacagccaataatgtttctctgagggaccttgcttctgtcagagactcgctctctctctcctcttcttgctctgctcagctctctcaccaactcatcttcagtcctcaaacaaacatctgttctcatctttgttttctttcctttctttctcatatctcattttcaattttcccaatttctcttcaacatcttcatagcaatttaagaccactattccattataaagctaactgctttagaaactcctcacatttatttcttccccatcattgttttagagagggagaaagaaaaagagctcagctttctgatggagaggagtattcaaggacaaaacaagctctgttgtttggaccaaaaagtgaatgtgagaagaagcctacaagttcaagaaactgtagaggatcatcaaagctttgcccttgaagaggaagaacaacaactctcaactccgagcttgctgcaagacacaacaataccatttctacaaatgctgcaacaaagtgaagacccttcaccgtttttgtcattcaaagacccaagctttctagcactactatctctccagacacttgaaaagccttgggaactcgaaaactacctcccacatgaagttccagagtttcattcaccgatccattctgaaaccaaccactactatcataatccatctttggaaggagtcaatgaagccatctcaaaccaagaacttccattcaacccactagagaatgcgcgttcaagacgcaagcggaaaaacaacaacttggcatcattgatgacaagagaaaagcgaaagagaagaagaactaaaccaacaaagaacatagaagagatagagagtcaaagaatgacacacattgcggttgaacgaaaccgcagacgccaaatgaacgttcatctgaactcactccgctccatcattccatcttcatacatccagaggggagaccaagcgtcaatagtaggaggagcaatagacttcgtaaagatcctagagcaacagttgcaatcccttgaagcacaaaagagaagtcaacagagtgatgataacaaagagcaaattccagaagataacagtctcaggaacatttcgtcgaacaagttgcgtgcgagtaataaagaagaacaaagtagcaaactcaaaatcgaagccacagtgatagagagtcacgtcaacctaaaaattcaatgtacgaggaaacaaggacaacttctcagatcaatcatattgctggagaaacttcgattcactgttcttcatctcaacatcacatctccgaccaatacatctgtctcttattccttcaacctcaagatggaagatgaatgtaatttgggatcagcggatgagataacggcggcgattcgtcagattttcgacagctgattgactaatccaagtaaaaagtaaaataaaaaaagaaacgtttactttggtaacttcgttttcatgattaaattctttatttggtcgtatgtgattggagtcttctcggcatggaacttgactttggttttagggtactagtctctacagaagctgtggtccttctttggatgc

SEQ ID NO: 2548 - protein, 359 aa, Arabidopsis thaliana
  G1227
MERSIQGQNKLCCLDQKVNVRRSLQVQETVEDHQSFALEEEEQQLSTPSLLQDTTIPFLQMLQQSEDPSPFLSFKDPSFLALLSLQTLEKPWELENYLPHEVPEFHSPIHSETNHYYHNPSLEGVNEAISNQELPFNPLENARSRRKRKNNNLASLMTREKRKRRRTKPTKNIEEIESQRMTHIAVERNRRRQMNVHLNSLRSIIPSSYIQRGDQASIVGGAIDFVKILEQQLQSLEAQKRSQQSDDNKEQIPEDNSLRNISSNKLRASNKEEQSSKLKIEATVIESHVNLKIQCTRKQGQLLRSIILLEKLRFTVLHLNITSPTNTSVSYSFNLKMEDECNLGSADEITAAIRQIFDS

SEQ ID NO: 2549 - DNA, 1196 bp, Arabidopsis thaliana
  G1228
gcatttataattactcactcatcttcttttcattacattacataccaaacaagagctctcaaatggaaaggtttcaaggacacatcaacccctgtttcttcgatcgaaaaccggatgtgagaagcctcgaggttcaaggatttgcagaggctcaaagctttgctttcaaagaaaaagaggaagaaagcttacaagatacagttccatttctacagatgctgcaaagtgaagacccctcatcgtttttttcaatcaaagagccaaactttctgacgctactgtctcttcaaaccctcaaggagccttgggaactcgaaagatatctttcacttgaggattcacaatttcattcaccggtccaatctgagaccaaccgcttcatggaaggagccaatcaagctgtgtcaagccaagaaattccctttagccaagcaaacatgacactcccttcttctacctcatcaccactcagtgcacattcaagacgaaagcgcaaaatcaaccacttgctgcctcaagaaatgactagagaaaagagaaagaggaggaaaacaaaaccaagtaaaaacaatgaagagattgagaatcaaagaataaaccacattgctgttgaacgaaacagaagacgtcaaatgaacgaacatatcaactctctccgggcccttctcccaccttcctacatccaacgaggagaccaagcttccatagtaggaggagcaataaactacgtgaaggtcctcgagcaaatcatacaatctctcgaatcgcaaaagagaacgcaacaacaaagtaacagtgaggtagtagaaaacgcacttaatcatctctcaggcatttcgtcgaacgacctgtggacaactcttgaagatcaaacttgtatccccaaaatcgaagctacagtgatacaaaaccatgtcagccttaaagttcaatgtgagaagaaacaaggacaacttctcaaaggaatcatatcacttgaaaagcttaaactcactgttcttcatctcaatatcactacttcgtctcattcctctgtttcttattccttcaacctcaagatggaagatgagtgcgacttagagtcagccgacgagattacggcggctgttcatcggattttcgatattccgacaatttgattaaacacatataattccaaaaatattaacagctgacaaaatggtatctttgcggcc

SEQ ID NO: 2550 - protein, 358 aa, Arabidopsis thaliana
  G1228
MERFQGHINPCFFDRKPDVRSLEVQGFAEAQSFAFKEKEEESLQDTVPFLQMLQSEDPSSFFSIKEPNFLTLLSLQTLKEPWELERYLSLEDSQFHSPVQSETNRFMEGANQAVSSQEIPFSQANMTLPSSTSSPLSAHSRRKRKINHLLPQEMTREKRKRRKTKPSKNNEEIENQRINHIAVERNRRRQMNEHINSLRALLPPSYIQRGDQASIVGGAINYVKVLEQIIQSLESQKRTQQQSNSEVVENALNHLSGISSNDLWTTLEDQTCIPKIEATVIQNHVSLKVQCEKKQGQLLKGIISLEKLKLTVLHLNITTSSHSSVSYSFNLKMEDECDLESADEITAAVHRIFDIPTI

SEQ ID NO: 2551 - DNA, 1118 bp, Arabidopsis thaliana
  G1231
caaacccaaattctctcagcgccggtcaaatacttgtctctctctctctctctctttcactcttgtcttgtctccttcgaagctgtttgttctgtaagaaagatggaagcaggtggcgcgtacaatccacgcactgttgaagaggtgtttagggattttaagggtcgtagagctggcatgattaaggctttaaccactgatgttcaggagtttttccgactttgtgatcccgaaaaggagaacctttgcctttacggacatccaaatgagcactgggaagtgaatttgccagctgaagaggttcctcctgagctcccagagcctgtcttgggtatcaattttgccagagacgggatggcggaaaaggattggttgtcccttgttgctgtccacagtgatgcttggcttcttgctgttgctttcttttttggagccaggtttggatttgacaaagctgataggaagaggcttttcaatatggtgaatgacctcccaacaatctttgaggttgtagctggcactgctaagaaacaaggaaaagataagtcctctgtttccaacaacagcagcaacagatccaaatcaagctccaagcgaggatctgaatcccgtgccaagttctcaaagccggagcccaaagatgatgaggaggaggaagaggaaggtgtggaagaggaggatgaggatgagcaaggtgaaacacagtgtggagcatgtggtgagagctatgcagctgatgagttctggatttgctgtgacctctgtgagatgtggtttcatggaaagtgtgttaagataacaccagcaagagctgagcacatcaagcaatacaagtgcccttcttgcagcaacaaaagggctcgttcctaaatttgttgaccgctcgcttctgtgtatctacctttgcatatgatgatgaacagcttaactgtttggtttagatcagatttgtcatatggatttggtaatttaggaagacattttagttttttcattgttacattttggcgattgaagggataactctttgtttaggggtaatgatcttttgctctgttttatgtttgtttattaacattcttcaaactcaatcaaaagtattttggttagtcttaaaa

SEQ ID NO: 2552 - protein, 255 aa, Arabidopsis thaliana
  G1231
MEAGGAYNPRTVEEVFRDFKGRRAGMIKALTTDVQEFFRLCDPEKENLCLYGHPNEHWEVNLPAEEVPPELPEPVLGINFARDGMAEKDWLSLVAVHSDAWLLAVAFFFGARFGFDKADRKRLFNMVNDLPTIFEVVAGTAKKQGKDKSSVSNNSSNRSKSSSKRGSESRAKFSKPEPKDDEEEEEEGVEEEDEDEQGETQCGACGESYAADEFWICCDLCEMWFHGKCVKITPARAEHIKQYKCPSCSNKRARS

SEQ ID NO: 2553 - DNA, 3174 bp, Arabidopsis thaliana
  G1243
atggcgagaaattcgaattccgatgaggctttctcgtcagaggaggaagaagagcgggttaaggataatgaagaagaagatgaggaggagctcgaggctgttgctcgttcttctggctccgacgatgacgaagtagccgccgccgacgaatcaccagtctccgacggagaggctgctcccgtagaagatgattacgaggacgaagaagatgaggaaaaagctgaaatcagcaaacgtgagaaagccagacttaaagagatgcagaagttgaagaagcagaagattcaagagatgctggagtcgcagaatgcttccattgacgcggatatgaacaataagggaaaagggagactgaagtatcttctgcagcaaactgagttatttgcccactttgctaaaagtgatggatcttcttctcagaagaaggcaaaaggaaggggacgtcatgcttccaaaataactgaagaggaggaagacgaagagtatctaaaggaagaagaggatggcttaactggatctggaaacacacggttactcacacagccctcttgtattcaagggaagatgagagattaccaattagctggtttgaactggctcattcgtctttatgagaatggcataaatggaattcttgctgatgaaatgggtctggggaagacgcttcaaacgatttctttgttggcatatcttcatgaatacaggggaatcaatggtccccatatggtggttgctccaaaatcaacacttggtaattggatgaacgaaattcgccggttttgtcctgtcctacgtgctgtgaagttccttggtaatcctgaggagaggagacatattcgagaagacctgctagttgctgggaaatttgatatttgtgtcacaagctttgagatggccatcaaagagaagacagcacttcgtcggtttagctggcgttatattatcattgatgaagcgcatcgaatcaagaacgagaattcactcctttctaaaaccatgagactttttagcaccaattatcggcttcttatcacggggaccccccttcagaataatctccatgaactgtgggctcttctaaattttcttctgcctgagatttttagttcagcagagacttttgatgaatggtttcaaatttctggtgagaatgaccagcaagaagttgtgcaacaactgcacaaggttcttcgaccatttcttcttcgaagactaaagtcagatgttgagaaaggtttgccaccgaagaaggagaccatacttaaagttggtatgtctcagatgcaaaagcaatactacaaggctttactgcagaaggatcttgaagcggttaatgctggtggagaacgcaaacgtctgctaaacattgcaatgcaactgcgtaaatgctgcaatcacccctatctcttccagggtgcagaacctggtcccccatataccacaggagatcaccttataacaaatgctggtaagatggttctcttggataaattgcttcctaagttgaaagaacgtgattcaagggtgctgatattttctcagatgacaagacttttggatattcttgaggactatttaatgtatcgtggttacttgtattgccgtattgatggaaacactggtggtgacgaacgagatgcctccatagaagcctacaacaagccaggaagtgagaaatttgttttcttgttatctactagagctggagggcttggtatcaatcttgctactgcagatgttgtgatcctttacgatagtgattggaacccacaagtcgacttgcaagctcaggatcgtgcccataggattggtcaaaaaaaagaagttcaagtgtttcgattctgcactgagtctgctattgaggagaaagtgattgaaagagcttacaagaagttagcacttgatgctctggttattcaacaagggagattggcagaacagaaaagtaagtctgtcaataaggatgagttgcttcaaatggtaagatatggtgctgagatggtgttcagttctaaagatagcacaatcacagacgaggatattgatagaatcattgccaaaggagaagaggcaacagctgaacttgatgctaagatgaagaaattcacagaagatgctatacagtttaaaatggatgacagtgctgacttctatgattttgatgatgacaataaggatgaaaacaagctcgattttaaaaagattgtaagcgacaattggaatgatccccccaagcgggagagaaagcgcaactactctgaatctgagtactttaagcaaacattgcggcaaggtgctccagctaaacctaaagagcctagaattccgcgcatgccccagttgcacgatttccagttctttaacattcagagattgaccgagttgtatgaaaaggaagtacgttatctcatgcaaacacatcagaaaaatcagttgaaagacacaattgatgttgaagaaccagaaggtggggatcccttaactactgaagaagtagaagaaaaggagggattattggaggagggtttctcaacatggagcagaagagattttaatactttcctcagggcttgtgagaagtatggccgcaacgacataaaaagcattgcctctgagatggaagggaaaacagaggaagaagttgaaagatatgccaaagtatttaaagagcggtacaaggagctgaacgactatgatagaatcattaagaacattgagaggggagaggcaaggatctctaggaaagacgaaatcatgaaggccatagggaagaaactggatcgctacagaaacccttggctggaactgaagattcaatatggtcagaacaaaggcaagctgtacaatgaagagtgtgaccgtttcatgatctgcatgattcacaaacttggttatgggaattgggatgagctaaaggcagcatttaggacatcgtctgtgttcaggtttgactggtttgtgaaatcccgcacgagtcaggaacttgcaagaagatgcgacactctgattcgactgatcgagaaagagaaccaggagtttgatgaaagagagaggcaagcccgcaaagagaagaagctcgcgaagagtgcaacaccatcaaagcgacctttaggaagacaagcaagtgagagtccttcatcgacgaagaagcggaagcacctgtcgatgagatga

SEQ ID NO: 2554 - protein, 1057 aa, Arabidopsis thaliana
  G1243
MARNSNSDEAFSSEEEEERVKDNEEEDEEELEAVARSSGSDDDEVAAADESPVSDGEAAPVEDDYEDEEDEEKAEISKREKARLKEMQKLKKQKIQEMLESQNASIDADMNNKGKGRLKYLLQQTELFAHFAKSDGSSSQKKAKGRGRHASKITEEEEDEEYLKEEEDGLTGSGNTRLLTQPSCIQGKMRDYQLAGLNWLIRLYENGINGILADEMGLGKTLQTISLLAYLHEYRGINGPHMVVAPKSTLGNWMNEIRRFCPVLRAVKFLGNPEERRHIREDLLVAGKFDICVTSFEMAIKEKTALRRFSWRYIIIDEAHRIKNENSLLSKTMRLFSTNYRLLITGTPLQNNLHELWALLNFLLPEIFSSAETFDEWFQISGENDQQEVVQQLHKVLRPFLLRRLKSDVEKGLPPKKETILKVGMSQMQKQYYKALLQKDLEAVNAGGERKRLLNIAMQLRKCCNHPYLFQGAEPGPPYTTGDHLITNAGKMVLLDKLLPKLKERDSRVLIFSQMTRLLDILEDYLMYRGYLYCRIDGNTGGDERDASIEAYNKPGSEKFVFLLSTRAGGLGINLATADVVILYDSDWNPQVDLQAQDRAHRIGQKKEVQVFRFCTESAIEEKVIERAYKKLALDALVIQQGRLAEQKSKSVNKDELLQMVRYGAEMVFSSKDSTITDEDIDRIIAKGEEATAELDAKMKKFTEDAIQFKMDDSADFYDFDDDNKDENKLDFKKIVSDNWNDPPKRERKRNYSESEYFKQTLRQGAPAKPKEPRIPRMPQLHDFQFFNIQRLTELYEKEVRYLMQTHQKNQLKDTIDVEEPEGGDPLTTEEVEEKEGLLEEGFSTWSRRDFNTFLRACEKYGRNDIKSIASEMEGKTEEEVERYAKVFKERYKELNDYDRIIKNIERGEARISRKDEIMKAIGKKLDRYRNPWLELKIQYGQNKGKLYNEECDRFMICMIHKLGYGNWDELKAAFRTSSVFRFDWFVKSRTSQELARRCDTLIRLIEKENQEFDERERQARKEKKLAKSATPSKRPLGRQASESPSSTKKRKHLSMR

SEQ ID NO: 2555 - DNA, 1746 bp, Arabidopsis thaliana
  G1246
atgatcatgtacggaggaggaggagcagggaaggacggtggatccaccaatcacttatcagacggaggagtgatattgaagaaaggtccatggacggcggcggaagatgagatacttgctgcgtacgttagagagaacggtgaagggaattggaacgccgttcagaaaaacacaggtttggctcgttgcggcaaaagctgccgtcttcgatgggccaatcacctccgaccaaatctgaaaaaaggctctttcaccggtgacgaagaacgtctcatcattcagcttcatgctcagcttggtaacaaatgggctcgcatggctgctcagttaccgggaagaacagacaacgagattaagaactattggaacacgagattgaaacgacttcttcgccaaggacttcctctttatcctccagatattatccctaaccatcaactccatccacatccacatcatcaacaacaacagcaacataaccatcatcatcatcatcatcaacaacaacaacaacatcaacaaatgtattttcaaccacaatcttcacaacgaaacacaccatcatcttcccctcttccatctccaacaccagcaaacgcaaagtcctcatcatccttcacttttcataccacgactgctaacctcctccatccacttagccctcacactccaaacacaccatctcaactctcttccacaccgcctccaccaccactttcctctcctttatgttcccctcgcaacaaccaatacccgacccttcccctctttgccctcccgcgttcccaaatcaacaacaacaacaacggaaatttcactttccctagacctccacctctccttcaaccgccttcatcactcttcgcaaaacgttacaacaatgctaacactcctcttaattgcatcaaccgcgtctcaaccgcaccattttcccctgtttcaagagactcctacacttcctttcttacattgccttacccttccccaaccgctcaaaccgctacttaccacaatactaataacccttactcttcctctccttccttctctttaaacccttcttcttcttcttaccctacatcaacttcttccccaagctttcttcactcccattacactccttcttccacctcatttcataccaacccagtttactccatgaaacaagagcagctcccttcaaaccaaattccccaaatagatggcttcaataacgtcaacaacttcacagacaacgagagacagaatcataaccttaacagttccggtgctcatagaagaagtagtagctgcagcctcttagaggatgtcttcgaagaggccgaagctttagcctctggaggcagaggccgacctccaaaacgaagacaactcacagcttctcttccgaaccacaacaacaacaccaacaacaacgacaacttcttctcggttagtttcggacattatgattcttctgacaacttatgttccttgcaagatttgaaatcaaaggaagaagagtctcttcaaatgaacacaatgcaggaggacatagctaagcttcttgattggggaagtgatagtggagagatctctaatggacaatcatctgttgtcactgacgacaatcttgttcttgatgttcatcaattagcttcactattcccggctgattctacagccgtcgtagccgcaacaaacgaccaacacaacaagaataataacaataattgttcctgggatgacatgcagggaataaggtag

SEQ ID NO: 2556 - protein, 581 aa, Arabidopsis thaliana
  G1246
MIMYGGGGAGKDGGSTNHLSDGGVILKKGPWTAAEDEILAAYVRENGEGNWNAVQKNTGLARCGKSCRLRWANHLRPNLKKGSFTGDEERLIIQLHAQLGNKWARMAAQLPGRTDNEIKNYWNTRLKRLLRQGLPLYPPDIIPNHQLHPHPHHQQQQQHNHHHHHHQQQQQHQQMYFQPQSSQRNTPSSSPLPSPTPANAKSSSSFTFHTTTANLLHPLSPHTPNTPSQLSSTPPPPPLSSPLCSPRNNQYPTLPLFALPRSQINNNNNGNFTFPRPPPLLQPPSSLFAKRYNNANTPLNCINRVSTAPFSPVSRDSYTSFLTLPYPSPTAQTATYHNTNNPYSSSPSFSLNPSSSSYPTSTSSPSFLHSHYTPSSTSFHTNPVYSMKQEQLPSNQIPQIDGFNNVNNFTDNERQNHNLNSSGAHRRSSSCSLLEDVFEEAEALASGGRGRPPKRRQLTASLPNHNNNTNNNDNFFSVSFGHYDSSDNLCSLQDLKSKEEESLQMNTMQEDIAKLLDWGSDSGEISNGQSSVVTDDNLVLDVHQLASLFPADSTAVVAATNDQHNKNNNNNCSWDDMQGIR

SEQ ID NO: 2557 - DNA, 1072 bp, Arabidopsis thaliana
  G1267
  misc_feature (46)..(46): n is a, c, g, or t
  misc_feature (61)..(61): n is a, c, g, or t
  misc_feature (63)..(63): n is a, c, g, or t
aagtagagaataataatcacatcaagattgtttataaccctccccntaatcaccttcttantnaccaccctctccggctctcaacagaacaacaacaaaaaaacagcttccgttgtcctgttccggcgaaatcggacggtcgagatcaatcatgcatcgtagagcagcaattcaagaatcggatgacgaagaagatgagacttacaacgacgtcgttcctgaatctccttcttcttgtgaagactcaaagatctcaaaaccaactccaaagaaaaggaggaacgtagagaagagagttgtctcagttccgatagctgacgtggaaggatctaagagcagaggcgaagtatatccaccgtccgattcatgggcctggagaaagtacggacaaaaaccgatcaaaggctcgccttatcccaggggatattacagatgtagtagctcaaaaggatgtccggcgaggaagcaggtggagagaagccgtgtggacccttctaagcttatgattacttacgcctgcgaccacaatcaccctttcccttcctcctccgctaacaccaaatcccaccaccgctcctccgtcgtcctcaaaaccgcaaagaaagaggaagaatacgaagaggaggaagaagaactaaccgtcaccgccgcagaggaaccaccggcgggacttgatctaagccacgtagactcaccgttgctattaggcggctgctacagcgaaatcggagagttcgggtggttctacgacgcgtcgatctcatcatcatctggttcttcgaatttcctcgacgtaactctagagagaggtttttcagtaggccaagaggaagatgagtctttgttcggtgatctcggtgatttacctgattgcgcctccgtgttccgccgtgggactgttgcgacggaggagcaacatcgaagatgtgattttggcgccattcctttctgtgatagttctagatgagtttgtgtgtgtagccaaaaccaaaagaaaaaaacacaatttttttattttccactgtaaaggtgtatcaatggtggattcatttttttaaaaaaaaaaaaaaaa

SEQ ID NO: 2558 - protein, 271 aa, Arabidopsis thaliana
  G1267
MHRRAAIQESDDEEDETYNDVVPESPSSCEDSKISKPTPKKRRNVEKRVVSVPIADVEGSKSRGEVYPPSDSWAWRKYGQKPIKGSPYPRGYYRCSSSKGCPARKQVERSRVDPSKLMITYACDHNHPFPSSSANTKSHHRSSVVLKTAKKEEEYEEEEEELTVTAAEEPPAGLDLSHVDSPLLLGGCYSEIGEFGWFYDASISSSSGSSNFLDVTLERGFSVGQEEDESLFGDLGDLPDCASVFRRGTVATEEQHRRCDFGAIPFCDSSR

SEQ ID NO: 2559 - DNA, 1166 bp, Arabidopsis thaliana
  G1269
aacaattctctctctctttattcttcttcttcagcttcagatttcagatcttaaatcttcaagtcttcttcttcttcttctgcaaccatggctatgcaggaacgttgtgagagtttatgttctgatgaacttatatcttcctcagatgccttttacctcaagacaagaaagccttataccatcactaaacaaagagagaaatggacagaagcagagcatgagaagtttgtagaagcattgaaactctatggcagagcttggagacgaatcgaagaacatgttggaacaaaaactgcagttcagattcgaagccatgcgcagaagttctttactaaggttgctcgcgattttggtgttagctctgagtccattgagatcccgcctccaaggccaaagagaaagccgatgcatccttaccctagaaagcttgtgattcctgatgcaaaagagatggtatacgctgaactaaccggatccaagctgattcaggatgaagataaccgatctccaacatcggttttatcagctcatggctcagatggattaggttccattggttcaaattcacctaactcttcttcagctgagttatcatctcacacagaggaatcattgtctctagaagcagagaccaaacagagccttaagctctttggaaaaacttttgtagttggtgattacaactcttcaatgagttgtgatgattctgaagatggcaagaagaagctatactcagaaacacagtctcttcaatgttcttcttctacttcagaaaacgctgaaacagaagtggtagtgtcggagttcaaaagaagtgagagatcagctttctctcagttaaaatcgtcggtgactgagatgaacaacatgagagggttcatgccttacaaaaagagagtaaaggtggaagaaaacattgacaatgtaaaattatcatatcctttgtggtgaagtgttcgtttgtgtcaagtcagttgtgtaaactcttttgatctcaacatcagattatgtgtataatgtcagagtattagggaaagtttttttggattagattcgtaagatcactccaaagtttcgtgtctttccatataaccagttagaaattgagatccttgtacttaaacatttttatttgatcaatcaaatcttcttgatgaaaaaaaaaa

SEQ ID NO: 2560 - protein, 287 aa, Arabidopsis thaliana
  G1269
MAMQERCESLCSDELISSSDAFYLKTRKPYTITKQREKWTEAEHEKFVEALKLYGRAWRRIEEHVGTKTAVQIRSHAQKFFTKVARDFGVSSESIEIPPPRPKRKPMHPYPRKLVIPDAKEMVYAELTGSKLIQDEDNRSPTSVLSAHGSDGLGSIGSNSPNSSSAELSSHTEESLSLEAETKQSLKLFGKTFVVGDYNSSMSCDDSEDGKKKLYSETQSLQCSSSTSENAETEVVVSEFKRSERSAFSQLKSSVTEMNNMRGFMPYKKRVKVEENIDNVKLSYPLW

SEQ ID NO: 2561 - DNA, 2793 bp, Arabidopsis thaliana
  G1272
atggattcaacaaatggtaacggagctgatcttgaatcagcaaatggggcaaacgggagtggggttactgaggcattaccacctcctccaccagttatacctccaaatgtggaaccagttcgtgttaaaactgaacttgctgagaagaaggggccagttcgagttcctatggctcgaaaaggatttggaacaaggggccaaaagatccccttgttaacaaatcatttcaaagtcgatgtggctaatcttcagggtcatttcttccactacagtgtggctctattctatgatgatggtcgtcctgttgaacaaaagggtgttggaagaaaaatccttgacaaggtgcatcagacttaccattctgatctggatggtaaagagtttgcttatgacggtgagaagacgttgtttacatatggagctttgcctagtaacaagatggatttttctgtggtgcttgaggaagtatctgctacaagtaaggattttgtgagcagggctaatggaaacggaagccccaatgggaatgaaagtccaagtgatggtgataggaaaagactgcgtaggcctaaccggtccaaaaactttagagtggagatcagctatgcggccaaaattcctcttcaagctcttgctaatgcaatgcggggacaagaatcagagaattcccaggaggcaatacgggttcttgatatcatattgaggcaacatgctgctagacaaggttgcttgcttgttcgacagtcttttttccacaatgatccaaccaactgtgaaccagttggtggtaacatcttaggatgtaggggatttcactccagtttcagaacaacgcagggtggcatgtcacttaatatggatgttacaaccaccatgatcatcaagcctggtccagtggttgatttcctaattgctaaccaaaatgctagggacccttattcgattgactggtctaaggctaaacgaacccttaagaacctaagggtaaaggtcagcccctcaggccaagaattcaagataaccggattgagtgacaagccttgcagggaacaaacgtttgaattgaagaaaaggaacccaaatgaaaatggagagttcgaaactactgaagttacagttgctgactacttccgcgatacaaggcatattgatttgcaatattctgcggatttgccttgcatcaatgttgggaagccaaagcgacccacttacattcctctcgagctctgcgcgttggttccacttcagaggtacacaaaagcacttaccacgttccaaagatctgcccttgttgagaaatccagacagaaaccccaagagaggatgactgttctgtccaaagctctgaaagttagcaactatgatgcggaaccactcctgcgatcctgtggcatttcgatcagctccaactttactcaggtggagggtcgtgttctaccagctcccaagctgaaaatgggatgtggatctgaaacctttcccagaaatggtcgctggaacttcaacaacaaggaatttgttgagcccaccaaaattcaacgatgggttgttgtcaatttctctgctcgctgtaatgtacgtcaagttgttgatgatctgataaaaattggaggatcaaaaggaattgaaattgcttctccctttcaagtgtttgaggagggtaatcaattccgccgtgctcctcctatgattcgtgttgagaacatgtttaaggacatccaatcgaaactccctggtgtcccacaattcatactatgtgtgctccctgacaaaaagaacagtgatctctatggtccatggaagaaaaaaaacttaactgaatttggcattgttactcaatgcatggctccaacgcggcaacctaatgatcagtatcttactaacttacttctgaagattaatgcaaagcttggaggcctgaactcaatgttaagtgtagagcgtacacctgcgttcactgtgatttctaaggttccaaccattatccttgggatggatgtttcacatggatctcctggacagtctgatgtcccgtccatcgctgctgtggtgagttctagggagtggccactgatatccaaatatagagcatctgttcggacacagccttctaaggctgagatgattgagtcccttgtcaagaaaaatggaactgaagacgatggcattatcaaggagttgctggtagatttctacaccagctcgaataagagaaaaccagagcatatcataattttcagggatggtgtgagtgaatctcaattcaatcaggttctgaatattgaacttgatcagatcatcgaggcttgcaagctcttagacgcaaattggaacccaaagttccttttgttggtggctcaaaagaatcatcataccaagttcttccagccaacgtctcctgaaaatgttcctccagggacaatcattgacaacaaaatatgtcacccaaagaacaatgatttctacctctgtgctcacgctggaatgattggaactacccgcccaactcactaccacgtcctgtatgatgagattggtttttcagctgacgaacttcaggaacttgtccactcgctctcctatgtgtaccaaagaagcaccagtgccatttctgttgttgcgccgatctgctatgctcacttggcagctgctcagcttgggacgttcatgaagtttgaagatcagtctgagacatcatcaagccatggtggtatcacagctccaggaccaatctctgttgcacagctcccaagactcaaagacaacgtcgccaactccatgttcttctgttaa

SEQ ID NO: 2562 - protein, 930 aa, Arabidopsis thaliana
  G1272
MDSTNGNGADLESANGANGSGVTEALPPPPPVIPPNVEPVRVKTELAEKKGPVRVPMARKGFGTRGQKIPLLTNHFKVDVANLQGHFFHYSVALFYDDGRPVEQKGVGRKILDKVHQTYHSDLDGKEFAYDGEKTLFTYGALPSNKMDFSVVLEEVSATSKDFVSRANGNGSPNGNESPSDGDRKRLRRPNRSKNFRVEISYAAKIPLQALANAMRGQESENSQEAIRVLDIILRQHAARQGCLLVRQSFFHNDPTNCEPVGGNILGCRGFHSSFRTTQGGMSLNMDVTTTMIIKPGPVVDFLIANQNARDPYSIDWSKAKRTLKNLRVKVSPSGQEFKITGLSDKPCREQTFELKKRNPNENGEFETTEVTVADYFRDTRHIDLQYSADLPCINVGKPKRPTYIPLELCALVPLQRYTKALTTFQRSALVEKSRQKPQERMTVLSKALKVSNYDAEPLLRSCGISISSNFTQVEGRVLPAPKLKMGCGSETFPRNGRWNFNNKEFVEPTKIQRWVVVNFSARCNVRQVVDDLIKIGGSKGIEIASPFQVFEEGNQFRRAPPMIRVENMFKDIQSKLPGVPQFILCVLPDKKNSDLYGPWKKKNLTEFGIVTQCMAPTRQPNDQYLTNLLLKINAKLGGLNSMLSVERTPAFTVISKVPTIILGMDVSHGSPGQSDVPSIAAVVSSREWPLISKYRASVRTQPSKAEMIESLVKKNGTEDDGIIKELLVDFYTSSNKRKPEHIIIFRDGVSESQFNQVLNIELDQIIEACKLLDANWNPKFLLLVAQKNHHTKFFQPTSPENVPPGTIIDNKICHPKNNDFYLCAHAGMIGTTRPTHYHVLYDEIGFSADELQELVHSLSYVYQRSTSAISVVAPICYAHLAAAQLGTFMKFEDQSETSSSHGGITAPGPISVAQLPRLKDNVANSMFFC

SEQ ID NO: 2563 - DNA, 978 bp, Arabidopsis thaliana
  G1304
atggggcgatcaccatgttgcgatgagaatggtctaaagaaagggccatggacacaagaggaggatgataaactgatagatcacattcaaaaacatggccatggcagctggagagctcttccaaagcaagccggtttaaaccgatgcggaaagagttgtagattaagatggaccaactacttgagacctgacatcaagagaggaaatttcactgaagaggaagaacaaactattatcaacctccattcccttcttggaaacaagtggtcgtcgatagccggtaatcttcctggaagaacggacaatgaaataaaaaactattggaacacacatttgagaaagaaacttctccaaatggggattgatccggtgacccataggccaagaaccgaccatctaaacgttttagcagctctcccgcagcttatagccgccgcaaatttcaacagcctcttgaatctcaaccaaaatgtgcaactggatgcaacaactcttgctaaagctcaactgctacacactatgattcaagtccttagcaccaataacaacaccaccaatccttctttttcttcatcaactatgcaaaacagtaacaccaatctctttggccaagcttcttacttagagaaccaaaatctttttggtcagtctcaaaacttctctcacattcttgaggatgagaatttgatggtcaaaacccaaattattgataaccctttggactctttttcttcccccatacaacccggttttcaagatgatcataattcactccctctattggttccggcgtctcctgaagaatctaaagaaactcaaaggatgatcaagaacaaagacatcgtcgattaccatcatcatgatgcttcaaacccttcatcatcaaactcaacgtttacacaagatcatcatcacccatggtgtgacactattgatgatggagcaagtgattctttttggaaagagataatagagtaa

SEQ ID NO: 2564 - protein, 325 aa, Arabidopsis thaliana
  G1304
MGRSPCCDENGLKKGPWTQEEDDKLIDHIQKHGHGSWRALPKQAGLNRCGKSCRLRWTNYLRPDIKRGNFTEEEEQTIINLHSLLGNKWSSIAGNLPGRTDNEIKNYWNTHLRKKLLQMGIDPVTHRPRTDHLNVLAALPQLIAAANFNSLLNLNQNVQLDATTLAKAQLLHTMIQVLSTNNNTTNPSFSSSTMQNSNTNLFGQASYLENQNLFGQSQNFSHILEDENLMVKTQIIDNPLDSFSSPIQPGFQDDHNSLPLLVPASPEESKETQRMIKNKDIVDYHHHDASNPSSSNSTFTQDHHHPWCDTIDDGASDSFWKEIIE

SEQ ID NO: 2565 - DNA, 912 bp, Arabidopsis thaliana
  G1309
cgtcgacctcttaattaagacgacttgagagagaaagaaagatacgtggaagatgaccaaatctggagagagaccaaaacagagacagaggaaagggttatggtcacctgaagaagaccagaagctcaagagtttcatcctctctcgtggccatgcttgctggaccactgttcccatcctagctggattgcaaaggaatgggaaaagctgcagattaaggtggattaattacctaagaccaggactaaagagggggtcgtttagtgaagaagaagaagagaccatcttgactttacattcttccttgggtaacaagtggtctcggattgcaaaatatttaccgggaagaacagacaacgagattaagaactattggcattcctatctgaagaagagatggctcaaatctcaaccacaactcaaaagccaaatatcagacctcacagaatctccttcttcactactttcttgcgggaaaagaaatctggaaaccgaaaccctagatcacgtgatctccttccagaaattttcagagaatccaacttcatcaccatccaaagaaagcaacaacaacatgatcatgaacaacagtaataacttgcctaaactgttcttctctgagtggatcagttcttcaaatccacacatcgattactcctctgcttttacagattccaagcacattaatgaaactcaagatcaaatcaatgaagaggaagtgatgatgatcaataacaacaactactcttcacttgaggatgtcatgctccgtacagattttttgcagcctgatcatgaatatgcaaattattattcttctggagatttcttcatcaacagtgaccaaaattatgtctaagaagagtgaatatgatcgtaagaggaacataagctagttacttgtgttacagc

SEQ ID NO: 2566 - protein, 268 aa, Arabidopsis thaliana
  G1309
MTKSGERPKQRQRKGLWSPEEDQKLKSFILSRGHACWTTVPILAGLQRNGKSCRLRWINYLRPGLKRGSFSEEEEETILTLHSSLGNKWSRIAKYLPGRTDNEIKNYWHSYLKKRWLKSQPQLKSQISDLTESPSSLLSCGKRNLETETLDHVISFQKFSENPTSSPSKESNNNMIMNNSNNLPKLFFSEWISSSNPHIDYSSAFTDSKHINETQDQINEEEVMMINNNNYSSLEDVMLRTDFLQPDHEYANYYSSGDFFINSDQNYV

SEQ ID NO: 2567 - DNA, 800 bp, Arabidopsis thaliana
  G1311
aagtataataacacaaagaaacagagtaaaagaaagaaaaatggattttaagaaggaagaaacacttcgtagagggccatggctcgaagaagaagacgaacggctagtgaaggtcattagtcttttgggagaacgtcgttgggattctttagcaatagtttccggtttgaagaggagtggtaagagttgcaggctaaggtggatgaactatctgaatccgactctgaagcgtggaccgatgagtcaagaagaagagagaatcatctttcagctccatgctctatggggtaacaagtggtcgaagattgcgagaagattacccggtaggactgataacgagataaagaactattggagaactcattatagaaagaaacaggaagctcaaaactatggaaagctctttgagtggagaggaaatacaggagaagaattgttgcacaagtataaggaaacagagatcactaggacaaagacgacgtctcaagaacatggttttgttgaagttgtgagcatggaaagtggtaaagaagccaacggtggtgttggtggaagagaaagcttcggtgttatgaaatcaccgtatgaaaatcggatttcggattggatatcagagatttctactgaccagagtgaagcaaatctttcagaagatcacagcagcaatagctgcagtgagaacaatattaacattggtacttggtggtttcaagagactagggactttgaggagttttcatgttctctatggtcataattctaaagttggtttatttactttttaaaaaaaaaaaaaaaaa

SEQ ID NO: 2568 - protein, 238 aa, Arabidopsis thaliana
  G1311
MDFKKEETLRRGPWLEEEDERLVKVISLLGERRWDSLAIVSGLKRSGKSCRLRWMNYLNPTLKRGPMSQEEERIIFQLHALWGNKWSKIARRLPGRTDNEIKNYWRTHYRKKQEAQNYGKLFEWRGNTGEELLHKYKETEITRTKTTSQEHGFVEVVSMESGKEANGGVGGRESFGVMKSPYENRISDWISEISTDQSEANLSEDHSSNSCSENNINIGTWWFQETRDFEEFSCSLWS

SEQ ID NO: 2569 - DNA, 990 bp, Arabidopsis thaliana
  G1314
atgggaagagctccgtgttgcgacaagacaaaagtgaagcgagggccttggtcgcctgaagaagactctaaacttagagattacattgaaaagtatggtaatggtggaaattggatctctttccccctcaaagccggtttgaggagatgtgggaagagttgtagactgaggtggctaaactatttgagaccaaacataaagcatggtgacttctctgaggaagaagacaggatcatttttagtctcttcgctgccataggaagcaggtggtcaataatagcagctcatctaccgggacgaacagacaacgacataaaaaactattggaacacaaagctaaggaagaaactcttgtcttcttcctctgattcatcatcatcagccatggcttctccttatctaaaccctatttctcaggatgtgaaaagaccaacctcaccaacaacaatcccatcttcttcttacaatccgtatgctgaaaaccctaatcaatacccaacaaaatccctcatctccagcatcaatggcttcgaagctggtgacaaacagataatttcctatattaaccctaattatcctcaagatctctatctctcggacagcaacaacaacacctcgaacgcaaatggtttcttgctcaaccacaatatgtgtgatcagtacaagaaccacaccagtttttcttcagacgtcaatgggataagatcagagattatgatgaagcaagaagagataatgatgatgatgatgatagaccaccacattgaccagaggacaaaagggtacaatggggaattcacacaagggtattataattactacaatgggcatggggatttgaagcaaatgattagtggaacaggcactaattctaacataaacatgggtggttcaggttcatcttctagttcgataagcaacctagctgagaacaaaagcagtggtagcctcctactagaatacaaatgcttgccctatttctactcctag

SEQ ID NO: 2570 - protein, 329 aa, Arabidopsis thaliana
  G1314
MGRAPCCDKTKVKRGPWSPEEDSKLRDYIEKYGNGGNWISFPLKAGLRRCGKSCRLRWLNYLRPNIKHGDFSEEEDRIIFSLFAAIGSRWSIIAAHLPGRTDNDIKNYWNTKLRKKLLSSSSDSSSSAMASPYLNPISQDVKRPTSPTTIPSSSYNPYAENPNQYPTKSLISSINGFEAGDKQIISYINPNYPQDLYLSDSNNNTSNANGFLLNHNMCDQYKNHTSFSSDVNGIRSEIMMKQEEIMMMMMIDHHIDQRTKGYNGEFTQGYYNYYNGHGDLKQMISGTGTNSNINMGGSGSSSSSISNLAENKSSGSLLLEYKCLPYFYS

SEQ ID NO: 2571 - DNA, 849 bp, Arabidopsis thaliana
  G1317
atgggaagatcaccttgttgtgataaaaatggagtgaagaagggaccatggactgctgaggaggatcagaaactcatcgattatattcgatttcatggtcctggcaattggcgtacgctccccaaaaatgctggactccatagatgtggaaaaagctgccgtcttcgatggaccaattatctaagaccggacatcaagagaggaagattctcgttcgaggaagaagaaactatcattcagctacacagtgttatgggaaacaagtggtcagcaatagccgctcgtctaccagggaggaccgataacgaaataaaaaaccattggaacactcacatccgcaagagacttgtaaggagtggtatcgaccctgttactcattctccacgccttgatcttcttgatttgtcctcacttttgagtgcacttttcaaccagccaaacttttcagcagttgcaacacatgcgtcttctcttcttaatcctgatgtattgaggttggcctctctactactgccacttcaaaaccctaatccagtttacccatcgaacctcgaccaaaatcttcaaactccaaatacatcatcagaatcgtctcaaccacaagctgagactagtacagtcccaacaaactatgaaacttcatcattggagcctatgaacgcaagactcgacgacgttggtcttgcagatgtattaccacctttgtcagagagttttgacttagactcgctcatgtcaacgccaatgtcttctccacgacaaaatagcattgaagcagaaaccaactccagcactttcttcgactttggaattccggaagatttcatcttagatgactttatgttttaa

SEQ ID NO: 2572 - protein, 282 aa, Arabidopsis thaliana
  G1317
MGRSPCCDKNGVKKGPWTAEEDQKLIDYIRFHGPGNWRTLPKNAGLHRCGKSCRLRWTNYLRPDIKRGRFSFEEEETIIQLHSVMGNKWSAIAARLPGRTDNEIKNHWNTHIRKRLVRSGIDPVTHSPRLDLLDLSSLLSALFNQPNFSAVATHASSLLNPDVLRLASLLLPLQNPNPVYPSNLDQNLQTPNTSSESSQPQAETSTVPTNYETSSLEPMNARLDDVGLADVLPPLSESFDLDSLMSTPMSSPRQNSIEAETNSSTFFDFGIPEDFILDDFMF

SEQ ID NO: 2573 - DNA, 1081 bp, Arabidopsis thaliana
  G1318
aaaaatatgaggaagccagaggtagccattgcagctagtactcaccaagtaaagaagatgaagaagggactttggtctcctgaggaagactcaaagctgatgcaatacatgttaagcaatggacaaggatgttggagtgatgttgcgaaaaacgcaggacttcaaagatgtggcaaaagctgccgtcttcgttggatcaactatcttcgtcctgacctcaagcgtggcgctttctctcctcaagaagaggatctcatcattcgctttcattccatcctcggcaacaggtggtctcagattgcagcacgattgcctggtcggaccgataacgagatcaagaatttctggaactcaacaataaagaaaaggctaaagaagatgtccgatacctccaacttaatcaacaactcatcctcatcacccaacacagcaagcgattcctcttctaattccgcatcttctttggatattaaagacattataggaagcttcatgtccttacaagaacaaggcttcgtcaacccttccttgacccacatacaaaccaacaatccatttccaacgggaaacatgatcagccacccgtgcaatgacgattttaccccttatgtagatggtatctatggagtaaacgcaggggtacaaggggaactctacttcccacctttggaatgtgaagaaggtgattggtacaatgcaaatataaacaaccacttagacgagttgaacactaatggatccggaaacgcacctgagggtatgagaccagtggaagaattttgggaccttgaccagttgatgaacactgaggttccttcgttttacttcaacttcaaacaaagcatatgaatatttttacgtcatcttattcttttttctattgcggtttatactcaagattcttagccacacacacataaatgcaaatatatatacattgttagagagtattttgtatttcgtataatcttttcgtactagggcttgagccttgaggtcccatgtaacgattagtcaatgtaaaacatatatcctataataaataaataaaagaaataataagcacataaaaaaaaaaaaa

SEQ ID NO: 2574 - protein, 280 aa, Arabidopsis thaliana
  G1318
MRKPEVAIAASTHQVKKMKKGLWSPEEDSKLMQYMLSNGQGCWSDVAKNAGLQRCGKSCRLRWINYLRPDLKRGAFSPQEEDLIIRFHSILGNRWSQIAARLPGRTDNEIKNFWNSTIKKRLKKMSDTSNLINNSSSSPNTASDSSSNSASSLDIKDIIGSFMSLQEQGFVNPSLTHIQTNNPFPTGNMISHPCNDDFTPYVDGIYGVNAGVQGELYFPPLECEEGDWYNANINNHLDELNTNGSGNAPEGMRPVEEFWDLDQLMNTEVPSFYFNFKQSI

SEQ ID NO: 2575 - DNA, 1020 bp, Arabidopsis thaliana
  G1320
gaagatcataaagatcaaaaggagagaggtattaaaaaatgatgtgtagtcgaggccattggagacctgcagaagacgagaagctaagagaactcgtcgagcaatttggtcctcataattggaacgccatagctcagaagctctctggtcgatctggtaagagttgtagattgagatggtttaatcaattggatcctaggattaaccgaaaccctttcacggaggaagaagaagaaaggcttttagcgcctcatcggatccatgggaacagatggtctgtgatcgctagattttttcccggtcgaactgataacgctgttaaaaaccattggcacgtcatcatggctcgtcgtggccgagaacggtccaagctccgtccacgaggccttggccatgatggcacggtggctgcgactgggatgattggtaattataaagactgcgataaggagagaagattggcaaccacaaccgctatcaattttccttatcaattctctcatattaatcattttcaagtcctcaaagagtccttgaccggaaagatcgggttcagaaatagtactactccaatacaagaaggagcaatagaccaaactaaacgaccgatggagttctacaattttctccaagtaaacacggattcgaagatacacgaattgatagataattcaagaaaagacgaagaagaagatgtcgatcaaaacaaccgaattcgtaacgagaattgtgttccatttttcgactttttgtctgttggaaactctgcctctcagggtttatgttaatttgtccgtaccacatgtactataaggtggaccatatgttaactaaagataatgtagaaagtactaatcaattagagctcctgtttgagccaaatgtgaaaattagttaagacatcccaaacattttcttgtataacacatataaggttgtacttttatcaggtctaattttctatttttattttaaggatgtttaatcagacccataaccattcgataaaaaaaaaaaaaa

SEQ ID NO: 2576 - protein, 249 aa, Arabidopsis thaliana
  G1320
MMCSRGHWRPAEDEKLRELVEQFGPHNWNAIAQKLSGRSGKSCRLRWFNQLDPRINRNPFTEEEEERLLAPHRIHGNRWSVIARFFPGRTDNAVKNHWHVIMARRGRERSKLRPRGLGHDGTVAATGMIGNYKDCDKERRLATTTAINFPYQFSHINHFQVLKESLTGKIGFRNSTTPIQEGAIDQTKRPMEFYNFLQVNTDSKIHELIDNSRKDEEEDVDQNNRIRNENCVPFFDFLSVGNSASQGLC

SEQ ID NO: 2577 - DNA, 1041 bp, Arabidopsis thaliana
  G1321
gttcttgtattggtttggatcggtatacttagttgattacgtaattaaatagatcggcgtgaagaagaaaaatgatcatgtgcagccgaggccattggagaccagctgaagacgagaagctcaaggatcttgtcgaacaatacggtcctcacaattggaacgccattgctctcaagcttcctggtcgctctggtaagagttgtagattgagatggtttaatcaattggatccaaggatcaaccgaaaccctttcacggaagaagaagaagaaagacttttagcggctcatcggatccatgggaacagatggtccatcatcgcaaggcttttccctggaagaactgataacgccgtcaagaaccattggcacgtcatcatggctcgtcgcacacgccaaacctctaagcctcgtcttcttccctcgacgacttcgtcttcttctttaatggcgagtgaacaaatcatgatgagttctggtggttataatcataattatagttccgatgatcggaagaaaatatttccagcagactttataaatttcccttacaaattctctcatatcaatcatcttcacttcctaaaggagtttttccccggaaagatcgctttaagtcacaaagcaaatcagagtaagaagcctatggagttctacaattttctacaagtaaacacagattcaaacaagagcgagattatagatcaagattcaggtcaaagcaaacgcagtgactcggacaccaaacatgaaagtcatgttccattcttcgactttttatccgttggaaactctgcctcctaggattagtttttttgcagtaactcctaaatttctagattaactatttagtccgtatacgtacgagattatctaggtcgttagcatgtatgcttgatgtgtataatcactaactagtgagctattacctgcgaaaattgtaagaaaaatacataatgttgatgtatcacacattctcaatgtctgtaaaatttccatcgagttgttaactatcaaagttatccgtttgaaaaaaaaaaaa

SEQ ID NO: 2578 - protein, 243 aa, Arabidopsis thaliana
  G1321
MIMCSRGHWRPAEDEKLKDLVEQYGPHNWNAIALKLPGRSGKSCRLRWFNQLDPRINRNPFTEEEEERLLAAHRIHGNRWSIIARLFPGRTDNAVKNHWHVIMARRTRQTSKPRLLPSTTSSSSLMASEQIMMSSGGYNHNYSSDDRKKIFPADFINFPYKFSHINHLHFLKEFFPGKIALSHKANQSKKPMEFYNFLQVNTDSNKSEIIDQDSGQSKRSDSDTKHESHVPFFDFLSVGNSAS

SEQ ID NO: 2579 - DNA, 880 bp, Arabidopsis thaliana
  G1326
cgacggtacggtggagatagagatagcatccatggagatgtctagaggaagcaacagttttgacaataagaagcctagttgccaaagaggtcactggagacctgttgaagatgacaatctccggcaactcgttgaacaatacggtcccaagaactggaattttattgctcaacatctctatggaagatcagggaaaagctgtagattaagatggtacaaccaacttgatccaaacatcaccaagaaacccttcaccgaggaggaagaagagagactgcttaaagctcatcggatccaagggaatcgttgggcctccatagcccgactgttccccgggaggaccgacaacgctgtcaaaaaccattttcatgtcatcatggctagacgcaaacgggaaaacttctcttccacagctacttctacgttcaaccaaacttggcatactgttttgagccctagttctagtcttacaaggctaaatagatcccatttcgggctatggaggtatcgaaaggataagagttgcggtctctggccttactcttttgtttcaccacctacgaatggtcaatttggatcttcatctgtctctaacgtacaccacgaaatttatcttgagaggagaaagtcgaaagagttggtggatcctcagaattacacatttcatgcagccacaccagatcataagatgacttcaaatgaagatggaccatccatgggagatgatggtgagaagaacgatgttactttcattgattttcttggtgttggattagcttcttaggttataacatcacaagtcaaagcttttaagggtttctatcattagggttaggcatcattttcagccttttgcttccttaaactctcatatggatct

SEQ ID NO: 2580 - protein, 250 aa, Arabidopsis thaliana
  G1326
MEMSRGSNSFDNKKPSCQRGHWRPVEDDNLRQLVEQYGPKNWNFIAQHLYGRSGKSCRLRWYNQLDPNITKKPFTEEEEERLLKAHRIQGNRWASIARLFPGRTDNAVKNHFHVIMARRKRENFSSTATSTFNQTWHTVLSPSSSLTRLNRSHFGLWRYRKDKSCGLWPYSFVSPPTNGQFGSSSVSNVHHEIYLERRKSKELVDPQNYTFHAATPDHKMTSNEDGPSMGDDGEKNDVTFIDFLGVGLAS

SEQ ID NO: 2581 - DNA, 1161 bp, Arabidopsis thaliana
  G1328
aattcaatcactatatttttttaaaaacatttgacttcatcgatcggttaacaattaatcaaaaagatgggacgatcaccatgttgtgagaagaagaatggtctcaagaaaggaccatggactcctgaggaggatcaaaagctcattgattatatcaatatacatggttatggaaattggagaactcttcccaagaatgctgggttacaaagatgtggtaagagttgtcgtctccggtggaccaactatctccgaccagatattaagcgtggaagattctcttttgaagaagaagaaaccattattcaacttcacagcatcatgggaaacaagtggtctgcgattgcggctcgtttgcctggaagaacagacaacgagatcaaaaactattggaacactcacatcagaaaaagacttctaaagatgggaatcgacccggttacacacactccacgtcttgatcttctcgatatctcctccattctcagctcatctatctacaactcttcgcatcatcatcatcatcatcatcaacaacatatgaacatgtcgaggctcatgatgagtgatggtaatcatcaaccattggttaaccccgagatactcaaactcgcaacctctctcttttcaaaccaaaaccaccccaacaacacacacgagaacaacacggttaaccaaaccgaagtaaaccaataccaaaccggttacaacatgcctggtaatgaagaattacaatcttggttccctatcatggatcaattcacgaatttccaagacctcatgccaatgaagacgacggtccaaaattcattgtcatacgatgatgattgttcgaagtccaattttgtattagaaccttattactccgactttgcttcagtcttgaccacaccttcttcaagcccgactccgttaaactcaagttcctcaacttacatcaatagtagcacttgcagcaccgaggatgaaaaagagagttattacagtgataatatcactaattattcgtttgatgttaatggttttctccaattccaataaacaaaacgccattggaatagagttatgtaaacatgcaatcattgtatttgttatatagattttgttacatatccaaaatccaaaatactatagttttaaaataaaaaaaaaaaaaaaaaa

SEQ ID NO: 2582 - protein, 324 aa, Arabidopsis thaliana
  G1328
MGRSPCCEKKNGLKKGPWTPEEDQKLIDYINIHGYGNWRTLPKNAGLQRCGKSCRLRWTNYLRPDIKRGRFSFEEEETIIQLHSIMGNKWSAIAARLPGRTDNEIKNYWNTHIRKRLLKMGIDPVTHTPRLDLLDISSILSSSIYNSSHHHHHHHQQHMNMSRLMMSDGNHQPLVNPEILKLATSLFSNQNHPNNTHENNTVNQTEVNQYQTGYNMPGNEELQSWFPIMDQFTNFQDLMPMKTTVQNSLSYDDDCSKSNFVLEPYYSDFASVLTTPSSSPTPLNSSSSTYINSSTCSTEDEKESYYSDNITNYSFDVNGFLQFQ

SEQ ID NO: 2583 - DNA, 1274 bp, Arabidopsis thaliana
  G1334
atagctcccaactaataggaatctcaagcttctcactctctcttgtttttccattggacttttggaacataagctatgcaaactgaggagcttttgtcgccaccacagactccttggtggaatgcttttggatctcagccgttgactacagagagcctttccggcgaagcttctgattcattcaccggagttaaggcagttactacggaggcagaacaaggtgtggtggataaacaaacttctacaactctcttcactttctcacctggtggtgaaaagagttcaagagatgtgccaaagcctcatgttgctttcgcgatgcaatcagcttgcttcgagtttggatttgctcagccaatgatgtacacaaagcatcctcatgttgaacaatactatggagttgtttcagcatacggatctcagaggtcttcgggccgagtaatgattccactgaagatggagacagaagaagatggtaccatctatgtgaactcaaagcagtaccatggaattatcaggcgacgccagtcccgagcaaaggctgaaaaactgagtagatgccgtaagccatatatgcatcactcacgccatctccatgctatgcgccgtcctagaggatctggcgggcgtttcttgaacaccaagacagctgatgcggctaagcagtctaagccgagtaattctcagagttctgaagtctttcatccggaaaatgagaccataaactcatcgagggaagcaaatgagtcaaatctctcggattctgcagttacaagtatggattactttctaagttcgtcggcttattctcctggtggcatggtcatgcctatcaagtggaatgcagcagcaatggatattggctgctgcaaacttaatatatgatcagcagataggggacaagacatgattggtcaccagtccttttgtcttgtcccttatctttcagccaaacggaaagagaacttgtgtcttggaaaaaagacattgagtttccttggtttataagattggtccttttaccatccgtttggctgtaaacaggcaaatcatctttggctcatgcttcatcaagttcttatcttcgtctgttttcttctacgcatcttcataagatctctgaactagtgaataacatttcctagcatcatgtttcaactagtgtgtgttgtaagaaactctgccttatttccagatgatgtattgtgtgtaacgtgtttatgaaacaaacgtaagactttcaagttaaaaaaaaaaaaaaaaaaaaaaaaaaa

SEQ ID NO: 2584 - protein, 269 aa, Arabidopsis thaliana
  G1334
MQTEELLSPPQTPWWNAFGSQPLTTESLSGEASDSFTGVKAVTTEAEQGVVDKQTSTTLFTFSPGGEKSSRDVPKPHVAFAMQSACFEFGFAQPMMYTKHPHVEQYYGVVSAYGSQRSSGRVMIPLKMETEEDGTIYVNSKQYHGIIRRRQSRAKAEKLSRCRKPYMHHSRHLHAMRRPRGSGGRFLNTKTADAAKQSKPSNSQSSEVFHPENETINSSREANESNLSDSAVTSMDYFLSSSAYSPGGMVMPIKWNAAAMDIGCCKLNI

SEQ ID NO: 2585 - DNA, 1630 bp, Arabidopsis thaliana
  G1337
aatggatttgtcatcattcttctcaccgtccttagtctctgaaaataaattctgattttgatttcgaattttagggattttgagagagagtcagttatgagtagttcggagagagtaccgtgcgatttctgcggcgagcgtacggcggttttgttttgtagagccgatacggcgaagctgtgtttgccttgtgatcagcaagttcacacggcgaatctgttgtcgaggaagcacgtgcgatctcagatctgcgataattgcggtaacgagccagtctctgttcggtgtttcaccgataatctgattttgtgtcaggagtgtgattgggatgttcacggaagttgttcagtttccgatgctcatgttcgatccgccgtggaaggtttttccggttgtccatcggcgttggagcttgctgctttatggggacttgatttggagcaagggaggaaagatgaagagaatcaagttccgatgatggcgatgatgatggataatttcgggatgcagttggattcttgggttttgggatctaatgaattgattgttcccagcgatacgacgtttaagaagcgtggatcttgtggatctagttgtgggaggtataagcaggtattgtgtaagcagcttgaggagttgcttaagagtggtgttgtcggtggtgatggcgatgatggtgatcgtgaccgtgattgtgaccgtgagggtgcttgtgatggagatggagatggagaagcaggagaggggcttatggttccggagatgtcagagagattgaaatggtcaagagatgttgaggagatcaatggtggcggaggaggaggagttaaccagcagtggaatgctactactactaatcctagtggtggccagagttctcagatatgggattttaacttgggacagtcacggggacctgaggatacgagtcgagtggaagctgcatatgtagggaaaggtgctgcttcttcattcacaatcaacaattttgttgaccatatgaatgaaacttgttccactaatgtgaaaggtgtcaaagagattaaaaaggatgactacaagcgatcaacttcaggccaggtacaaccaacaaaatctgagagcaacaatcgtccaattacctttggctctgagaaaggttcgaactcctccagtgacttgcatttcacagagcatattgctggaactagttgtaagaccacaagactagttgcaactaaggctgatctggagcggctggctcagaacagaggagatgcaatgcagcgttacaaggaaaagaggaagacacggagatatgataagaccataaggtatgaatcgaggaaggcaagagctgacactaggttgcgtgtcagaggcagatttgtgaaagctagtgaagctccttacccttaaccttaagttttttcacataggcttccttttagctacaaacttagttactttttttactccactgcctcataaatgtacagaccggtctcgtttcatctggccgcccttcttgttttattgccttatctggcccttttatgtaccttggaatcttatctagtttaaaaaagattgtaaccttctagaaaaccatattctgttgacagtatatacatgtctatccaagcaaaaa

SEQ ID NO: 2586 - protein, 433 aa, Arabidopsis thaliana
  G1337
MSSSERVPCDFCGERTAVLFCRADTAKLCLPCDQQVHTANLLSRKHVRSQICDNCGNEPVSVRCFTDNLILCQECDWDVHGSCSVSDAHVRSAVEGFSGCPSALELAALWGLDLEQGRKDEENQVPMMAMMMDNFGMQLDSWVLGSNELIVPSDTTFKKRGSCGSSCGRYKQVLCKQLEELLKSGVVGGDGDDGDRDRDCDREGACDGDGDGEAGEGLMVPEMSERLKWSRDVEEINGGGGGGVNQQWNATTTNPSGGQSSQIWDFNLGQSRGPEDTSRVEAAYVGKGAASSFTINNFVDHMNETCSTNVKGVKEIKKDDYKRSTSGQVQPTKSESNNRPITFGSEKGSNSSSDLHFTEHIAGTSCKTTRLVATKADLERLAQNRGDAMQRYKEKRKTRRYDKTIRYESRKARADTRLRVRGRFVKASEAPYP

SEQ ID NO: 2587 - DNA, 1001 bp, Arabidopsis thaliana
  G1352
gcgcgattaaaaactctcaacttttctctcaaatttctgatcctttgatccaacagttagaagaagattcatctgatcatggccctcgaagcgatgaacactccaacttcttctttcaccagaatcgaaacgaaagaagatttgatgaacgacgccgttttcattgagccgtggcttaaacgcaaacgctccaaacgtcagcgttctcacagcccttcttcgtcttcttcctcaccgcctcgatctcgacccaaatcccagaatcaagatcttacggaagaagagtatctcgctctttgtctcctcatgctcgctaaagatcaaccgtcgcaaacgcgatttcatcaacagtcgcaatcgttaacgccgccgccagaatcaaagaaccttccgtacaagtgtaacgtctgtgaaaaagcgtttccttcctatcaggctttaggcggtcacaaagcaagtcaccgaatcaaaccaccaaccgtaatctcaacaaccgccgatgattcaacagctccgaccatctccatcgtcgccggagaaaaacatccgattgctgcctccggaaagatccacgagtgttcaatctgtcataaagtgtttccgacgggtcaagctttaggcggtcacaaacgttgtcactacgaaggcaacctcggcggcggaggaggaggaggaagcaaatcaatcagtcacagtggaagcgtgtcgagcacggtatcggaagaaaggagccaccgtggattcatcgatctaaacctaccggcgttacctgaactcagccttcatcacaatccaatcgtcgacgaagagatcttgagtccgttgaccggtaaaaaaccgcttttgttgaccgatcacgaccaagtcatcaagaaagaagatttatctttaaaaatctaatactcgactattaattcttgtgtgatttttttcgttacaaccatagtttcattttcatttttttagttacaaatttttaattgttctgatttggattgaaa

SEQ ID NO: 2588 - protein, 273 aa, Arabidopsis thaliana
  G1352
MALEAMNTPTSSFTRIETKEDLMNDAVFIEPWLKRKRSKRQRSHSPSSSSSSPPRSRPKSQNQDLTEEEYLALCLLMLAKDQPSQTRFHQQSQSLTPPPESKNLPYKCNVCEKAFPSYQALGGHKASHRIKPPTVISTTADDSTAPTISIVAGEKHPIAASGKIHECSICHKVFPTGQALGGHKRCHYEGNLGGGGGGGSKSISHSGSVSSTVSEERSHRGFIDLNLPALPELSLHHNPIVDEEILSPLTGKKPLLLTDHDQVIKKEDLSLKI

SEQ ID NO: 2589 - DNA, 1047 bp, Arabidopsis thaliana
  G1354
atggaaagtctcgcacacattcctcccggttatcgattccatccgaccgatgaagaactcgttgactattatctcaagaacaaagttgcattcccgggaatgcaagttgatgttatcaaagatgttgatctctacaaaatcgagccatgggacatccaagagttatgtggaagagggacaggagaagagagggaatggtatttctttagccacaaggacaagaaatatccaactgggacacgaaccaatagagcaacgggctccggattttggaaagcaacgggtcgagacaaggccatttactcaaagcaagagcttgttgggatgaggaagactcttgtcttttacaaaggtagggccccaaatggtcagaaatctgattggataatgcacgaataccgtcttgagaccgatgaaaatggaccgcctcatgaggaaggatgggtggtttgtcgcgctttcaagaagaagctaaccacgatgaactacaacaatccaagaacaatgatgggatcatcatcaggccaagaatctaactggttcacgcagcaaatggatgtggggaatggtaattactatcatcttcctgatctagagagtccgagaatgtttcaaggctcatcatcatcatcactatcatcattacatcagaatgatcaagacccttatggtgtcgtactcagcactattaacgcaaccccaactacaataatgcaacgagatgatggtcatgtgattaccaatgatgatgatcatatgatcatgatgaacacaagtactggtgatcatcatcaatcaggattactagtcaatgatgatcataatgatcaagtaatggattggcaaacgcttgacaagtttgttgcttctcagctaatcatgagccaagaagaggaagaagttaacaaagatccatcagataattcttcgaatgaaacatttcatcatctctctgaagagcaagctgcaacaatggtttcgatgaatgcttcttcctcttcttctccatgttccttctactcttgggctcaaaatacacacacgtaa

SEQ ID NO: 2590 - protein, 348 aa, Arabidopsis thaliana
  G1354
MESLAHIPPGYRFHPTDEELVDYYLKNKVAFPGMQVDVIKDVDLYKIEPWDIQELCGRGTGEEREWYFFSHKDKKYPTGTRTNRATGSGFWKATGRDKAIYSKQELVGMRKTLVFYKGRAPNGQKSDWIMHEYRLETDENGPPHEEGWVVCRAFKKKLTTMNYNNPRTMMGSSSGQESNWFTQQMDVGNGNYYHLPDLESPRMFQGSSSSSLSSLHQNDQDPYGVVLSTINATPTTIMQRDDGHVITNDDDHMIMMNTSTGDHHQSGLLVNDDHNDQVMDWQTLDKFVASQLIMSQEEEEVNKDPSDNSSNETFHHLSEEQAATMVSMNASSSSSPCSFYSWAQNTHT

SEQ ID NO: 2591 - DNA, 1257 bp, Arabidopsis thaliana
  G1360
atgggagatagaaacaacgacggtgatcagaaaatggaggatgtattgttgcccggatttaggtttcatccaaccgacgaagagctcgtaagcttctacctgaagcggaaggttcaacacaaccctctctccattgagctcataagacaactcgatatctacaaatatgacccctgggatcttccaaagtttgcgatgacgggtgaaaaagaatggtacttttattgtccaagggacaggaagtataggaacagctcgaggccaaaccgagtgaccggagctggtttttggaaagccacgggaacggaccggccgatatactcgtcagaaggaaacaaatgcataggtttaaagaagtccttagtgttctacaaaggaagagcagcgaaaggagttaagactgattggatgatgcatgagtttcgtttgccttctctctccgaaccatctcctccttctaagagattcttcgactctcctgtctctcccaacgattcatgggctatatgcagaatcttcaaaaagaccaacacaacgaccctaagagctctctctcactcttttgtttcctcgttaccaccagaaacaagcaccgacacaatgtctaaccaaaagcaatcaaacacataccatttttcttcagacaagatcctcaaacctagctctcacttccagtttcaccatgagaatatgaacactcccaaaactagtaatagtacaactccatccgttcccactataagtcccttctcttacttggatttcacttcatacgacaaacccaccaacgttttcaatccggtttcatgtttagaccaacaatacctcacaaatctctttcttgccacacaagaaacacaacctcagtttcccaggctcccctcgtcaaatgaaatcccatcgtttctgctaaacacgtcttcagattcgaccttcttgggagaattcacgagccatatcgacctcagcgcagtgttggcccaagagcaatgtcccccgcttgtaagcctaccacaggagtatcaagagacgggattcgaaggaaatggtataatgaagaacatgcgtggttccaatgaagatcatcttggtgatcattgcgacacacttcggtttgatgatttcacttcaacaattaatgagaaccatcgtcatcatcaagacctgaaacagaacatgacattgctggagagttattattcttctttatcgtccatcaatagcgatttgccagcttgtttctccagtacaacctga

SEQ ID NO: 2592 - protein, 418 aa, Arabidopsis thaliana
  G1360
MGDRNNDGDQKMEDVLLPGFRFHPTDEELVSFYLKRKVQHNPLSIELIRQLDIYKYDPWDLPKFAMTGEKEWYFYCPRDRKYRNSSRPNRVTGAGFWKATGTDRPIYSSEGNKCIGLKKSLVFYKGRAAKGVKTDWMMHEFRLPSLSEPSPPSKRFFDSPVSPNDSWAICRIFKKTNTTTLRALSHSFVSSLPPETSTDTMSNQKQSNTYHFSSDKILKPSSHFQFHHENMNTPKTSNSTTPSVPTISPFSYLDFTSYDKPTNVFNPVSCLDQQYLTNLFLATQETQPQFPRLPSSNEIPSFLLNTSSDSTFLGEFTSHIDLSAVLAQEQCPPLVSLPQEYQETGFEGNGIMKNMRGSNEDHLGDHCDTLRFDDFTSTINENHRHHQDLKQNMTLLESYYSSLSSINSDLPACFSSTT

SEQ ID NO: 2593 - DNA, 1964 bp, Arabidopsis thaliana
  G1367
tccttccacaaaacttttttaattttatctgaaaaattaaaacaaccgaaacaaaaaaaaaaaactaaaaatcaaaaatctcatcaccttccttgctctgtattttttctctctcactaaatcctccatggatccttctctctctgcaaccaatgatcctcatcatcctcctcctcctcagttcacatctttccctcctttcaccaacaccaaccccttcgcctctccaaaccaccccttcttcaccggacccaccgccgtcgcgccgccaaacaacatccatctctatcaagcagctcctccgcagcagccacaaacatctccagttcctcctcatccatctatttcccaccctccttactctgacatgatttgcacggcgattgcagcgttaaacgaaccagatgggtcaagcaagcaagctatttcgaggtacatagagagaatttacactgggattcctactgctcatggagctttgttgacacaccatctcaagactttgaagaccagtgggattcttgtcatggttaagaaatcttacaagcttgcttctactcctcctcctcctcctcctactagtgtagctcctagtcttgaacctcccagatctgatttcatagtcaacgagaaccaacctttacctgatccggttttggcttcttctactcctcagactattaaacgtggtcgtggtcgacctccaaaagctaaaccagatgttgttcaacctcaacctctgactaatggaaaactcacctgggaacagagtgaattacctgtctctcgaccagaggagatacagatacagccgccacagttaccgttacagccacagcagccggttaagagaccgccgggtcgtcctagaaaagatggaacttcgccgacggtgaagccagctgcttctgtttccggtggtgtggagactgtgaaacgaagaggtagacctccgagtggaagagctgctgggagggagagaaagcctatagtagtctcagctccagcttcagtgttcccgtatgttgctaatggtggtgttagacgccgagggagaccaaagagagttgacgctggtggtgcttcctctgttgctccaccaccaccaccaccaactaacgtagagagtggaggagaggaggttgcagtcaagaaacgaggaagaggacggcctcctaagattggaggtgttatcaggaagcctatgaagccgatgagaagctttgctcgtactggaaaacccgtaggaagacccagaaagaatgcggtgtcagtgggagcttctggacgacaagatggtgactatggagaactgaagaagaagtttgagttgtttcaagcgagagctaaggatattgtaattgtgttgaaatccgagataggaggaagtggaaatcaagcagtggttcaagccatacaggacctggaagggatagcagagacaacaaacgagccaaagcacatggaagaagtgcagctgccagacgaggaacaccttgaaaccgaaccagaagcagagggtcaaggacagacagaagcagaggcaatgcaagaagctctgttctaaagataaagccttgacataaaaagctagcaagtggtgggtttacttgttgtgtgttacatgaaatttttaatcttataagggtgtttgcaggagaaaaacaaaaagaacaatgtgatgaactgatgatgatgattgtgtctctaaccaaacaacaaggagaggtagggtaatgtctgtaaagtgaattaggatgttaccattgttcatgcttcccatctctctccatcgtccatatctgtgtaggcagctttgttctttgttccctcgtgttttttttagactgttgtgtctcttattctattttgtctccttaggctttttaggagttgttgttgatgtttatcaaaaacgcttatgtaatttttatgaccacttctactttttatgatggtttctt

SEQ ID NO: 2594 - protein, 479 aa, Arabidopsis thaliana
  G1367
MDPSLSATNDPHHPPPPQFTSFPPFTNTNPFASPNHPFFTGPTAVAPPNNIHLYQAAPPQQPQTSPVPPHPSISHPPYSDMICTAIAALNEPDGSSKQAISRYIERIYTGIPTAHGALLTHHLKTLKTSGILVMVKKSYKLASTPPPPPPTSVAPSLEPPRSDFIVNENQPLPDPVLASSTPQTIKRGRGRPPKAKPDVVQPQPLTNGKLTWEQSELPVSRPEEIQIQPPQLPLQPQQPVKRPPGRPRKDGTSPTVKPAASVSGGVETVKRRGRPPSGRAAGRERKPIVVSAPASVFPYVANGGVRRRGRPKRVDAGGASSVAPPPPPPTNVESGGEEVAVKKRGRGRPPKIGGVIRKPMKPMRSFARTGKPVGRPRKNAVSVGASGRQDGDYGELKKKFELFQARAKDIVIVLKSEIGGSGNQAVVQAIQDLEGIAETTNEPKHMEEVQLPDEEHLETEPEAEGQGQTEAEAMQEALF

SEQ ID NO: 2595 - DNA, 1017 bp, Arabidopsis thaliana
  G1381
cagctttaacactactctctctctctctcaaatgggaaaacaaatcaacatagagagtagtgctactcatcatcaagacaatattgtttccgttataacagccacgatatcctcctcctccgtcgtaacgtcttcgtcagactcttggtctacctccaaaagatcgttagtgcaagacaatgactccggagggaaacggcggaagagcaacgttagtgatgataacaagaatccgacgtcgtatagaggagtgaggatgaggagttggggaaaatgggtgtcggagattagagagccgaggaagaaatcaagaatatggcttggcacttatccaacggcagagatggcagctcgtgctcatgatgtggcggctttagctattaaaggcaactccggttttcttaatttccctgaattatccggtttgcttcctcgtccggttagctgctctcctaaggatatacaagctgcagctaccaaagccgccgaagcaaccacgtggcacaaaccggttatcgataagaaattagctgatgagctaagccactctgagttgttgtctaccgctcagtcttcgacttctagtagtttcgtgttttcttcggacacgtcggagacttctagtacggacaaggaaagcaacgaagagacggtgtttgatttgccggaccttttcacggacgggcttatgaacccaaacgatgcgttttgtttatgcaacggcacctttacgtggcagctttacggagaggaggatgtagggttcaggtttgaagagccgtttaattggcaaaatgactaaaccgccctccacttgcttactgtaattactaacatataattttcttgataaagaacatatatttccattacggtattaactaatcttttctatccttttctcttttcttgtttctacatctgagtatattgtcactatgtgaaaaaattgatctcgttttgaatatttacttttcaaaattgaagtaacgcaagtgattgataaaaaaaaaaaaa

SEQ ID NO: 2596 - protein, 256 aa, Arabidopsis thaliana
  G1381
MGKQINIESSATHHQDNIVSVITATISSSSVVTSSSDSWSTSKRSLVQDNDSGGKRRKSNVSDDNKNPTSYRGVRMRSWGKWVSEIREPRKKSRIWLGTYPTAEMAARAHDVAALAIKGNSGFLNFPELSGLLPRPVSCSPKDIQAAATKAAEATTWHKPVIDKKLADELSHSELLSTAQSSTSSSFVFSSDTSETSSTDKESNEETVFDLPDLFTDGLMNPNDAFCLCNGTFTWQLYGEEDVGFRFEEPFNWQND

SEQ ID NO: 2597 - DNA, 2008 bp, Arabidopsis thaliana
  G1382
ctctcatttcgccatagctgagagcttcttctactttcccttagcttcttttttccttcatttttgttctacccttgcgaatctctgaaatgaaccctcaagctaatgaccggaaggagtttcagggagattgttcggcgacgggagatctcacggcaaagcacgattcagctggaggaaacggaggtggaggtgctaggtataagctgatgtcaccggccaagcttccgatctcgaggtcgactgatatcacgattcctcctgggttgagtccgacttcgtttttggaatctcctgttttcatctccaacatcaagccagaaccttcccctactactggttctttgttcaagcctcgaccagtgcacatttctgctagctcaagttcttatacaggcagggggttccatcagaacacctttactgagcagaagtccagtgaatttgagttcagacctcctgcatcaaatatggtatatgcagagcttggcaagattagaagtgagccaccagtacattttcaaggccagggccatggatcctcacactcaccttcttcgatcagtgatgctgcaggttcctcaagtgagctaagccggccaactcctccttgtcagatgacaccaacgagctcagatattccggctggatctgatcaagaggaatcaatccagacttcccaaaatgactccagaggaagcactccatccatcttggctgatgatggttataactggagaaaatatggtcaaaagcatgtcaaagggagtgaatttccccggagctattataaatgtacacatcctaattgtgaagtgaaaaagttatttgaaagatctcatgatgggcagatcaccgatattatatacaagggtacacatgaccatcctaaacctcaacctggtcgccgaaactctggtggtatggctgcacaagaagaaaggctagacaagtatccttcttcaactggccgagatgagaagggatctggcgtctacaacttgtctaaccccaatgaacaaactggtaaccctgaagtacctcctatctcagcatctgacgatggtggagaagcggcagcgtcaaataggaataaagatgagccggacgatgatgatccattctcaaaacggaggaggatggagggtgcgatggaaataactccactagtgaaacccatccgggagcctcgggttgttgttcaaactctgagtgaggttgacattctggatgatggttatagatggcgcaaatatgggcagaaagtcgtaagggggaacccaaatcccaggagctactacaaatgcacagctcatggatgcccagtgagaaaacacgtggagagagcatcacatgatccaaaagctgtaataacaacatacgaaggcaaacacgatcatgatgttcccacttcaaagtctagcagcaatcacgaaatccagcctcggttcagaccagatgaaacagacaccatcagcctcaatcttggtgttggaatctcatctgatggacctaaccacgcttccaacgaacatcagcaccagaatcaacaacttgtcaaccaaactcacccaaatggagtcaatttcaggtttgttcatgctagtcccatgtcatcctactatgctagcttaaatagcggtatgaatcagtacggccagagagaaacaaagaacgagactcaaaatggtgacatctcgtccttgaacaattcatcttacccatatccgcccaacatggggagagtacaatcgggtccgtaaaacaaaaagtaagcaacattatgtacgggatcttcttaggttaggaatgggacgaggccttgttctatataattcctatttcttcacagagagctgatcttgattcaaactatctccaccatatatatttgtttgtgtcacctgtattgagttccaaaaatgttatgtaaaaatacacaacaagatgttaatgcttttatttaaacaagaaacagcaatattactacaaaaaaaaaaaaaaaaaa

SEQ ID NO: 2598 - protein, 557 aa, Arabidopsis thaliana
  G1382
MNPQANDRKEFQGDCSATGDLTAKHDSAGGNGGGGARYKLMSPAKLPISRSTDITIPPGLSPTSFLESPVFISNIKPEPSPTTGSLFKPRPVHISASSSSYTGRGFHQNTFTEQKSSEFEFRPPASNMVYAELGKIRSEPPVHFQGQGHGSSHSPSSISDAAGSSSELSRPTPPCQMTPTSSDIPAGSDQEESIQTSQNDSRGSTPSILADDGYNWRKYGQKHVKGSEFPRSYYKCTHPNCEVKKLFERSHDGQITDIIYKGTHDHPKPQPGRRNSGGMAAQEERLDKYPSSTGRDEKGSGVYNLSNPNEQTGNPEVPPISASDDGGEAAASNRNKDEPDDDDPFSKRRRMEGAMEITPLVKPIREPRVVVQTLSEVDILDDGYRWRKYGQKVVRGNPNPRSYYKCTAHGCPVRKHVERASHDPKAVITTYEGKHDHDVPTSKSSSNHEIQPRFRPDETDTISLNLGVGISSDGPNHASNEHQHQNQQLVNQTHPNGVNFRFVHASPMSSYYASLNSGMNQYGQRETKNETQNGDISSLNNSSYPYPPNMGRVQSGP

SEQ ID NO: 2599 - DNA, 979 bp, Arabidopsis thaliana
  G1384
ggcggatctcttcggtggtggccacggcggcgagcttatggaagcacttcaacctttttacaaaagtgcttccacgtctgcttcaaatcctgcgtttgcgtcctcaaacgatgcgtttgcgtctgccccaaacgacctattttcttcttcttcttactataatcctcatgcatctttattcccttcacattccacaacctcttacccggatatttattctggatccatgacctatccatcttcattcgggtcggatcttcaacaacccgaaaactaccaatctcagttccattaccaaaacactatcacttacactcaccaagacaacaacacttgcatgcttaacttcattgagccgagccaaccgggttttatgacccaaccgggtccgagttcgggttcggtttcaaaaccggctaagctctatagaggagtgaggcaaagacattggggaaaatgggtcgcggagatccgtttacccaggaaccgaacccgactttggctcggaacattcgacacggctgaagaagccgcgttggcttatgatcgcgccgcgtttaagcttcgtggtgactcggctcggcttaacttcccagctctccgataccaaaccggctcgtctccgtctgataccggcgaatatggtcctattcaagctgccgtagacgctaaactagaagccatattagctgagccgaagaatcagccgggcaaaacggagaggacgtcgaggaaacgagctaaagccgcggcttcttcagctgagcagccgtcagcgccacaacaacattccgggtcgggtgaaagtgatgggtcgggttcaccgacttcggatgttatggtgcaggagatgtgccaagagccagagatgccatggaatgaaaatttcatgctcggcaagtgtccttcttatgagatagattgggcttcaattttatcgtgaaaaattaggattcaattcatttttattcattttaac

SEQ ID NO: 2600 - protein, 301 aa, Arabidopsis thaliana
  G1384
MEALQPFYKSASTSASNPAFASSNDAFASAPNDLFSSSSYYNPHASLFPSHSTTSYPDIYSGSMTYPSSFGSDLQQPENYQSQFHYQNTITYTHQDNNTCMLNFIEPSQPGFMTQPGPSSGSVSKPAKLYRGVRQRHWGKWVAEIRLPRNRTRLWLGTFDTAEEAALAYDRAAFKLRGDSARLNFPALRYQTGSSPSDTGEYGPIQAAVDAKLEAILAEPKNQPGKTERTSRKRAKAAASSAEQPSAPQQHSGSGESDGSGSPTSDVMVQEMCQEPEMPWNENFMLGKCPSYEIDWASILS

SEQ ID NO: 2601 - DNA, 845 bp, Arabidopsis thaliana
  G1386
aattttatttccttctctcaaatcttcccaccaaaaattaactctttcgttcacactaagtcccttttaaaagaaaatatcccaattaatggaacgtgacgactgccggagatttcaggactcgccggcgcagacgacggagagaagagtgaaatataaaccaaagaagaaaagagccaaagatgatgatgatgagaaagttgtttcgaagcatccaaattttcgaggtgtcagaatgagacaatggggaaaatgggtgtccgaaatcagagagccaaaaaagaaatcaagaatctggctcggtactttctccacggcggagatggcggcgcgtgctcacgacgtggcagctttagccatcaaaggcggttctgcacatctcaacttcccggagctcgcttatcacctccctagaccagctagtgccgaccctaaagacatccaagctgccgccgccgcagctgcagccgctgtggccattgacatggatgtagagacgtcttcgccgtcgccatctcccacagttacggaaacgtcatctccggctatgatagcactctccgacgacgcgttctccgatcttcctgatctcttgctcaacgtgaaccataacatcgatggcttctgggactcttttccctatgaagaacccttcctctctcaaagttactagaaactcaaaactatgtcgtttttgtatgtatttttgtcatgtgaccattttttgacgtcgaaaatcacccggataatccaaattgtatgatttattaatggttgatgattttctttgtgtggaacaatgtgtatgatacgtaatcaaaagttcaaaaaaaaaataaaaaaaa

SEQ ID NO: 2602 - protein, 194 aa, Arabidopsis thaliana
  G1386
MERDDCRRFQDSPAQTTERRVKYKPKKKRAKDDDDEKVVSKHPNFRGVRMRQWGKWVSEIREPKKKSRIWLGTFSTAEMAARAHDVAALAIKGGSAHLNFPELAYHLPRPASADPKDIQAAAAAAAAAVAIDMDVETSSPSPSPTVTETSSPAMIALSDDAFSDLPDLLLNVNHNIDGFWDSFPYEEPFLSQSY

SEQ ID NO: 2603 - DNA, 436 bp, Arabidopsis thaliana
  G1396
tcgacctcgtttcctttcctcctctcttcctaccattagtacgttactggagctgatctcacgtatattttggatcgtaatcatggacggcgaagattttgccggaaaggcggctgctgaagccaagggattgaacccgggattaatcgtgctgcttgttgttggaggtccgcttcttgtgttcctaatcgccaactacgtgctttacgtttatgctcagaagaacctacctccaaggaagaagaagcccgtttccaaaaagaagctcaagcgggagaagctaaagcaaggagtccctgtccctggagaataaaagccagcttaagcttccttcacttgtgcctccttcaaagcggtttttgttcggttaccaaatttcacccttgcgggtttttttcttcctttacttctgtcatgaggattatctttgaggcct

SEQ ID NO: 2604 - protein, 76 aa, Arabidopsis thaliana
  G1396
MDGEDFAGKAAAEAKGLNPGLIVLLVVGGPLLVFLIANYVLYVYAQKNLPPRKKKPVSKKKLKREKLKQGVPVPGE

SEQ ID NO: 2605 - DNA, 1674 bp, Arabidopsis thaliana
  G1399
aggtcgaattttctgaaattaagattcattcctccatggaagaagctctgtttttattctctttagcttagcttagcttctactgatctgtttttgctacaaaatcccatctttttctttaaaactctttatctctgaatcttgagtttcttgtagaagaagaagcaattttgaatctttcgtaatcataaagattcgtggaggatctctactgatttgtcggaatctctcactacagaatcacttgatcttatgtccggatggaggagagagaaggaaccaacatcaacaacaacatcactagcagtttcggcttgaagcagcaacatgaagctgctgcttctgatggtggttactcaatggacccaccaccaagacccgaaaaccctaacccgtttttagtcccacccactactgtccccgcggccgccaccgtagcagcagctgttactgagaatgcggctactccgtttagcttaacaatgccgacggagaacacttcagctgagcagctgaaaaagaagagaggtaggccgagaaagtataatcccgatgggactcttgtcgtgactttatcgccgatgccaatctcgtcctctgttccgttgacgtcggagtttcctccaaggaaacgaggaagaggacgtggcaagtctaatcgatggctcaagaagtctcaaatgttccaattcgatagaagtcctgttgataccaatttggcaggtgtaggaactgctgattttgttggtgccaactttacacctcatgtactgatcgtcaacgccggagaggatgtgacgatgaagataatgacattctctcaacaaggatctcgtgctatctgcatcctttcagctaatggtcccatctccaatgttacgcttcgtcaatctatgacatccggtggtactctaacttatgagggtcgttttgagattctctctttgacgggttcgtttatgcaaaatgactctggaggaactcgaagtagagctggtggtatgagtgtttgccttgcaggaccagatggtcgtgtctttggtggaggactcgctggtctctttcttgctgctggtcctgtccaggtaatggtagggacttttatagctggtcaagagcagtcacagctggagctagcaaaagaaagacggctaagatttggggctcaaccatcttctatctcctttaacatatccgcagaagaacggaaggcgagattcgagaggcttaacaagtctgttgctattcctgcaccaaccacttcatacacgcatgtaaacacaacaaatgcggttcacagttactatacaaactcggttaaccatgtcaaggatcccttctcgtctatcccagtaggaggaggaggaggtggagaggtaggagaagaagagggtgaagaagatgatgatgaattagaaggtgaagacgaagaattcggaggcgatagccaatctgacaacgagattccgagctgatgatgatcatacggtttcttttcgcggatttgttaggtttgatggatttcagattttggttgattgtttttattaacacagaatgtttagaagctgctatctttaggttcccatcctcttgtgattgttgagtatccttgttagaaacaaacttactgttgcaaaactctcttcaaaaaagtttcactttgctttccca

SEQ ID NO: 2606 - protein, 404 aa, Arabidopsis thaliana
  G1399
MEEREGTNINNNITSSFGLKQQHEAAASDGGYSMDPPPRPENPNPFLVPPTTVPAAATVAAAVTENAATPFSLTMPTENTSAEQLKKKRGRPRKYNPDGTLVVTLSPMPISSSVPLTSEFPPRKRGRGRGKSNRWLKKSQMFQFDRSPVDTNLAGVGTADFVGANFTPHVLIVNAGEDVTMKIMTFSQQGSRAICILSANGPISNVTLRQSMTSGGTLTYEGRFEILSLTGSFMQNDSGGTRSRAGGMSVCLAGPDGRVFGGGLAGLFLAAGPVQVMVGTFIAGQEQSQLELAKERRLRFGAQPSSISFNISAEERKARFERLNKSVAIPAPTTSYTHVNTTNAVHSYYTNSVNHVKDPFSSIPVGGGGGGEVGEEEGEEDDDELEGEDEEFGGDSQSDNEIPS

SEQ ID NO: 2607 - DNA, 894 bp, Arabidopsis thaliana
  G1412
atgggtgttagagagaaagatccgttagcccagttgagtttgccaccaggttttagattttatccgacagatgaagagcttcttgttcagtatctatgtcggaaagttgcaggctatcatttctctctccaggtcatcggagacatcgatctctacaagttcgatccttgggatttgccaagtaaggctttgtttggagagaaggaatggtatttctttagcccaagagatcggaaatatccgaacgggtcaagacccaatagagtagccgggtcgggttattggaaagcaacgggtactgacaaaattatcacggcggatggtcgtcgtgtcgggattaaaaaagctctggtcttttacgccggaaaagctcccaaaggcactaaaaccaactggattatgcacgagtatcgcttaatagaacattctcgtagccatggaagctccaagttggatgattgggtgttgtgtcgaatttacaagaaaacatctggatctcagagacaagctgttactcctgttcaagcttgtcgtgaagagcatagcacgaatgggtcgtcatcgtcttcttcatcacagcttgacgacgttcttgattcgttcccggagataaaagaccagtcttttaatcttcctcggatgaattcgctcaggacgattcttaacgggaactttgattgggctagcttggcaggtcttaatccaattccagagctagctccgaccaatggattaccgagttacggtggttacgatgcgtttcgagcggcggaaggtgaggcggagagtgggcatgtgaatcggcagcagaactcgagcgggttgactcagagtttcgggtacagctcgagtgggtttggtgtttcgggtcaaacattcgagtttaggcaatga

SEQ ID NO: 2608 - protein, 297 aa, Arabidopsis thaliana
  G1412
MGVREKDPLAQLSLPPGFRFYPTDEELLVQYLCRKVAGYHFSLQVIGDIDLYKFDPWDLPSKALFGEKEWYFFSPRDRKYPNGSRPNRVAGSGYWKATGTDKIITADGRRVGIKKALVFYAGKAPKGTKTNWIMHEYRLIEHSRSHGSSKLDDWVLCRIYKKTSGSQRQAVTPVQACREEHSTNGSSSSSSSQLDDVLDSFPEIKDQSFNLPRMNSLRTILNGNFDWASLAGLNPIPELAPTNGLPSYGGYDAFRAAEGEAESGHVNRQQNSSGLTQSFGYSSSGFGVSGQTFEFRQ

SEQ ID NO: 2609 - DNA, 861 bp, Arabidopsis thaliana
  G1415
ccttatcactcaccaaaagtcgtcacataatatcactttcgagttatcaacatccgtacatgtcatccatagagccaaaagtaatgatggttggtgctaataagaaacaacgaaccgtccaagctagttcgaggaaaggttgtatgagaggaaaaggtggacccgataacgcgtcttgcacttacaaaggtgttagacaacgcacttggggcaaatgggtcgctgagatccgcgagcctaaccgaggagctcgtctttggctcggtaccttcgacacctcccgtgaagctgccttggcttatgactccgcagctcgtaagctctatgggcctgaggctcatctcaacctccctgagtccttaagaagttaccctaaaacggcgtcgtctccggcgtcccagactacaccaagcagcaacaccggtggaaaaagcagcagcgactctgagtcgccgtgttcatccaacgagatgtcatcatgtggaagagtgacagaggagatatcatgggagcatataaacgtggatttgccggtaatggatgattcttcaatatgggaagaagctacaatgtcgttaggatttccatgggttcatgaaggagataatgatatttctcggtttgatacttgtatttccggtggctattctaattgggattcctttcattccccactttgaggtgtcactagactctctttaattgttaagttatcatatacaaactacatatatatacaaatatagtcaccgtgaactaggatatatatgtaaataaacaccagttacatgtacttatatatgtgcacatctatatatgtggtttgtctgtatagtgtgaaagcagattcttaccatatca

SEQ ID NO: 2610 - protein, 206 aa, Arabidopsis thaliana
  G1415
MSSIEPKVMMVGANKKQRTVQASSRKGCMRGKGGPDNASCTYKGVRQRTWGKWVAEIREPNRGARLWLGTFDTSREAALAYDSAARKLYGPEAHLNLPESLRSYPKTASSPASQTTPSSNTGGKSSSDSESPCSSNEMSSCGRVTEEISWEHINVDLPVMDDSSIWEEATMSLGFPWVHEGDNDISRFDTCISGGYSNWDSFHSPL

SEQ ID NO: 2611 - DNA, 1306 bp, Arabidopsis thaliana
  G1420
aaagtatcatctcatagattccatcttttctctattacatggagaagaaaaaagaagaggatcatcatcatcaacaacaacaacaacaacaaaaggagatcaagaacacagagacaaagatcgagcaagaacaagaacaagaacaaaaacaagaaatctctcaagcatcatcatcatcaaacatggcgaatctagttacgtcatcagatcatcatccgttggagctagctggaaatctctcaagcatcttcgatacttcatctttaccttttccttattcttatttcgaagatcactcttctaataatcctaattctttcctagacttgctccgacaagatcatcagtttgcttcttcctctaattcctcttctttttcattcgatgcctttcctctccccaataacaacaacaacacctctttttttacggatttgcccttacctcaagctgagtcatcagaagtcgtgaacacaacaccgacttctccaaactcaacctcagtctcatcttcctccaacgaagctgcaaatgataacaacagtggtaaagaagttactgttaaagatcaagaagaaggagatcaacaacaagagcaaaagggtactaagccacagttgaaggcaaagaagaagaatcaaaagaaagctagagaagctaggtttgcgtttctgacgaagagcgatattgataatcttgacgacggttataggtggagaaaatacggccaaaaagctgtcaaaaacagtccttatcccagaagctattaccgttgcaccacagtgggttgcggagtgaagaagagagtggagagatcctccgatgatccttcgatcgtcatgacaacctacgaaggtcagcatacccatcctttccccatgacgccacgtggacacatcggaatgctcacgtcaccaatcctagaccacggtgcaaccaccgcgtcatcatcatcattctccatccctcagccacgttacttgctgactcaacatcaccagccctacaacatgtacaacaacaactctctaagtatgatcaatagaagatcatccgatggcactttcgtaaatccaggtccatcatcatcattccccggctttggttatgatatgtctcaagcttctacttcaacttcttcttccattagagatcatggattgcttcaagatattcttccttcgcagatcagatccgatactattaacactcaaaccaatgaagagaataagaaatgaagaagttttttttcccggggcaattgtttttttctttaggccggatccggtaggtaggtttcatgagc

SEQ ID NO: 2612 - protein, 399 aa, Arabidopsis thaliana
  G1420
MEKKKEEDHHHQQQQQQQKEIKNTETKIEQEQEQEQKQEISQASSSSNMANLVTSSDHHPLELAGNLSSIFDTSSLPFPYSYFEDHSSNNPNSFLDLLRQDHQFASSSNSSSFSFDAFPLPNNNNNTSFFTDLPLPQAESSEVVNTTPTSPNSTSVSSSSNEAANDNNSGKEVTVKDQEEGDQQQEQKGTKPQLKAKKKNQKKAREARFAFLTKSDIDNLDDGYRWRKYGQKAVKNSPYPRSYYRCTTVGCGVKKRVERSSDDPSIVMTTYEGQHTHPFPMTPRGHIGMLTSPILDHGATTASSSSFSIPQPRYLLTQHHQPYNMYNNNSLSMINRRSSDGTFVNPGPSSSFPGFGYDMSQASTSTSSSIRDHGLLQDILPSQIRSDTINTQTNEENKK

SEQ ID NO: 2613 - DNA, 1260 bp, Arabidopsis thaliana
  G1421
gaaatttcatccctaaataagaaaaaagcatctccttctttagtgtcctccttcaccaaactcttgattccataagcatatattaaaaaagctctctgctttcttcaactttcccgggaaaatcttcttgttacaaagcatcaatctcttgttttaccaattttctctctttattccttttttgccctttacttttcctaactttggtctttatatataaacacacgacacaaagaagaacacacataagttaaaactattacaacagttttaaagagagagatttaaaaaatggagacagagaagaaagtttctctcccaagaatcttacgaatctctgttactgatccttacgcaacagattcgtcaagcgacgaagaagaagaagttgattttgatgcattatctacaaaacgacgtcgtgttaagaagtacgtgaaggaagtggtgcttgattcggtggtttctgataaagagaagccgatgaagaagaagagaaagaagcgcgttgttactgttccagtggttgttacgacggcgacgaggaagtttcgtggagtgaggcaaagaccgtggggaaaatgggcggcggagattagagatccgagtagacgtgttagggtttggttaggtacttttgacacggcggaggaagctgccattgtttacgataacgcagctattcagctacgtggtcctaacgcagagcttaacttccctcctcctccggtgacggagaatgttgaagaagcttcgacggaggtgaaaggagtttcggattttatcattggcggtggagaatgtcttcgttcgccggtttctgttctcgaatctccgttctccggcgagtctactgcggttaaagaggagtttgtcggtgtatcgacggcggagattgtggttaaaaaggagccgtcttttaacggttcagatttctcggcgccgttgttctcggacgacgacgtttttggtttctcgacgtcgatgagtgaaagtttcggcggcgatttatttggagataatctttttgcggatatgagttttggatccgggtttggattcgggtctgggtctggattctccagctggcacgttgaggaccattttcaagatattggggatttattcgggtcggatcctgtcttaactgtttaagaaataactggccgtttaacggcgtttagtgaagttttgttaccggcgacggcgaggattaaaaaaaaacggcgatttattttttgaatgaagatttgttaaata

SEQ ID NO: 2614 - protein, 287 aa, Arabidopsis thaliana
  G1421
METEKKVSLPRILRISVTDPYATDSSSDEEEEVDFDALSTKRRRVKKYVKEVVLDSVVSDKEKPMKKKRKKRVVTVPVVVTTATRKFRGVRQRPWGKWAAEIRDPSRRVRVWLGTFDTAEEAAIVYDNAAIQLRGPNAELNFPPPPVTENVEEASTEVKGVSDFIIGGGECLRSPVSVLESPFSGESTAVKEEFVGVSTAEIVVKKEPSFNGSDFSAPLFSDDDVFGFSTSMSESFGGDLFGDNLFADMSFGSGFGFGSGSGFSSWHVEDHFQDIGDLFGSDPVLTV

SEQ ID NO: 2615 - DNA, 1281 bp, Arabidopsis thaliana
  G1435
gtgaaacatggggaaggaagttatggtgagcgattacggtgacgacgacggagaagacgccggcggcggcgatgaatataggattccggaatgggaaattggtttacccaacggagatgatttgactccgttatctcaatatctagtcccgtcgattctcgcgttagctttcagcatgatcccagaacgaagccgtacaattcacgacgtcaatcgcgcgtcgcaaatcacgctctcttcgttgagaagcagtaccaatgcttcgtctgtgatggaggaggtcgtggatcgagttgaatcgagtgttccaggatcagatccgaagaaacagaagaaatcggatggtggtgaagcagcggcggtggaggattccacggcggaggaaggagactccgggcctgaagacgcgtctgggaagacatcgaaacgaccgcgtttagtgtggacaccgcagctacacaagagatttgtggacgttgtggctcatctagggattaaaaacgcagtgccgaagacgattatgcagctgatgaacgtggaaggacttactcgtgagaacgttgcgtctcatttgcagaaatataggctttaccttaaacggattcaaggattgacgacggaagaagatccttattcgtcgtcggatcagctcttctcttcaacgccggttcctccacagagctttcaagacggcggaggaagtaacggaaagttgggggttccggttccggttccgtcgatggtgcctattccaggctatgggaatcaaatgggtatgcaaggatattatcaacagtatagtaaccatggcaatgaatcaaaccaatatatgatgcagcagaataagtttggaacaatggtgacatatccttctgttggtggtggtgacgtgaatgacaagtaaatggatcttaaaggtctataatttgctctacagagagatactggttcttggcttatggtttattttcccacttcatgaggttgttgtgacttttaattctccatgttttccacacaagtctttattgcctttgtatagaaaatgatttcgagaaaatcactgggaagcttggtattgttggaggatgaagccttctatgaatgatttagtttcctactgtctccattctttatgaggtaataaagccttcttttgctcatcgcttgtagtcttcttaaattcaagacagcgtcacatgtttgttcggttatgttaattgtttctttctttggataatgaagatagcatcaggtctcatgtctcctcactttgataaa

SEQ ID NO: 2616 - protein, 298 aa, Arabidopsis thaliana
  G1435
MGKEVMVSDYGDDDGEDAGGGDEYRIPEWEIGLPNGDDLTPLSQYLVPSILALAFSMIPERSRTIHDVNRASQITLSSLRSSTNASSVMEEVVDRVESSVPGSDPKKQKKSDGGEAAAVEDSTAEEGDSGPEDASGKTSKRPRLVWTPQLHKRFVDVVAHLGIKNAVPKTIMQLMNVEGLTRENVASHLQKYRLYLKRIQGLTTEEDPYSSSDQLFSSTPVPPQSFQDGGGSNGKLGVPVPVPSMVPIPGYGNQMGMQGYYQQYSNHGNESNQYMMQQNKFGTMVTYPSVGGGDVNDK

SEQ ID NO: 2617 - DNA, 1293 bp, Arabidopsis thaliana
  G1442
atgggaacaagagcagaacgcaaggaagattttgttggtgggtttggatttggtgttgtagaaaattcgcataaagacgttatggtgctacctcatcatcactattatccatcatattcatcaccttcctcttcttctttgtgttactgttctgctggtgttagcgatcccatgttctctgtttctagcaatcaggcttacacttcttctcacagtggtatgttcacacccgccggttctggttctgctgctgtgactgtagcagatccttttttctccttgagctcttcaggggaaatgagaagaagtatgaacgaagatgctggtgcagctttcagcgaagctcaatggcatgagcttgagaggcagaggaatatatacaagtacatgatggcttctgttcctgttcctccagagcttctcacaccctttcccaagaaccaccaatcaaacactaacccggatgtaactgtggcagtggcgacaggaggctcattgcagctggggattgcttcaagcgcaagcaataacacggctgatctggagccatggaggtgcaagagaacagatgggaagaaatggaggtgctctagaaacgtgattcctgatcagaaatactgtgagagacacacacacaagagccgtcctcgttcaagaaagcatgtggaatcatctcaccaatcatctcaccacaatgacattcgtacggctaagaatgatactagccagcttgtgagaacttatcctcagttttacggacaacctataagccagatccctgtgctttctactcttccgtctgcctcctctccatatgatcaccacagaggactgaggtggtttacgaaagaagatgatgccattggaaccttaaacccggagactcaagaagctgtccagctgaaagttggatcaagcagagagctcaaacggggattcgattatgatctgaatttcaggcagaaagagccaatagtagaccagagctttggagcattgcagggtctattaagtctaaaccagacaccacaacataaccaagaaacaagacagtttgttgtagaaggaaagcaagatgaagcgatgggaagctctctgacactctcaatggctggaggaggcatggaggaaacagagggaacaaaccagcatcagtgggttagccatgaaggtccatcatggctctattcaacaacaccaggtggaccattggctgaagcactgtgtctcggtgtctccaacaacccaagttctagtactactactagtagctgcagcagaagctcaagctaa

SEQ ID NO: 2618 - protein, 430 aa, Arabidopsis thaliana
  G1442
MGTRAERKEDFVGGFGFGVVENSHKDVMVLPHHHYYPSYSSPSSSSLCYCSAGVSDPMFSVSSNQAYTSSHSGMFTPAGSGSAAVTVADPFFSLSSSGEMRRSMNEDAGAAFSEAQWHELERQRNIYKYMMASVPVPPELLTPFPKNHQSNTNPDVTVAVATGGSLQLGIASSASNNTADLEPWRCKRTDGKKWRCSRNVIPDQKYCERHTHKSRPRSRKHVESSHQSSHHNDIRTAKNDTSQLVRTYPQFYGQPISQIPVLSTLPSASSPYDHHRGLRWFTKEDDAIGTLNPETQEAVQLKVGSSRELKRGFDYDLNFRQKEPIVDQSFGALQGLLSLNQTPQHNQETRQFVVEGKQDEAMGSSLTLSMAGGGMEETEGTNQHQWVSHEGPSWLYSTTPGGPLAEALCLGVSNNPSSSTTTSSCSRSSS

SEQ ID NO: 2619 - DNA, 1148 bp, Arabidopsis thaliana
  G1444
aatcccctatccttcgcaagacccttcctctatataaggaagttcatttcatttttttttgacacgctgacaagctgactctagcatatctggcaccggcgaccagtccttctttggtgcaaagatcccaaaaaatcaaaatcgaaagagagaataaatcaaaaggaagaatctttatctgctttctctcgatgaggatccggaaacgacaagtgcctcttcctttatcgtctctattaccagttcctctatcagatctctactttaaccgctcaccgacggccaccgcgagatactttcgcggtggttataaagacggcggtgatgattttggttctcttcagctttcgcttccgccgccgtcgcagatttctgatcggcttattcaaagagatttgataaagaagaaggaggaggtcaaggctttggatgatgataatggtgatgtagacgtcaagagtcgtactgatgcatcgggcagcaagaatgttaatccccgaggagaatccgtctcttcaatacaagttgtcgagaagaatgaaaaggttgtgtctttgaggaagagaagaggctttatcaactttgaggattacgaagatgaggaagatgaagaagctagtggcggtggaggccgtattaataaagggaaaaagaaagcgaaaaagagcggtggtgggttagaggaaggatcacggtgcagccgtgttaacggtagaggatggagatgttgtcagcaaacgcttgttggttattctctttgtgagcatcatctcggtaaaggaagggtaaggagcatgaacaagagtggtggtggtcgtggcggcgagaaaaaggcggtggtggtggaagtgaagaagaagagagtaaagcttggcatggtaaaggcacgttcaataagtagtttgcttggacaaaccagcactagtggtggtactagtggtgatgttgatcagggtgagataagtgcacctgctgatcagttcgctgcatgtgataagtaggtctgttgatcagcatttgcatgtatatggatatgtgtatgtttatgtacatgatgataatgggcatagcgcggccgctctagacaggcctggaaccggatcctctagctagagctttcgttagtatcatcgggtttagacaacgtt

SEQ ID NO: 2620 - protein, 269 aa, Arabidopsis thaliana
  G1444
MRIRKRQVPLPLSSLLPVPLSDLYFNRSPTATARYFRGGYKDGGDDFGSLQLSLPPPSQISDRLIQRDLIKKKEEVKALDDDNGDVDVKSRTDASGSKNVNPRGESVSSIQVVEKNEKVVSLRKRRGFINFEDYEDEEDEEASGGGGRINKGKKKAKKSGGGLEEGSRCSRVNGRGWRCCQQTLVGYSLCEHHLGKGRVRSMNKSGGGRGGEKKAVVVEVKKKRVKLGMVKARSISSLLGQTSTSGGTSGDVDQGEISAPADQFAACDK

SEQ ID NO: 2621 - DNA, 1177 bp, Arabidopsis thaliana
  G1447
aaaaaccctaaccctaattctctcaagacaactcaaaggtctctccttttttaggtttattatcacttccgtataatcgccatgtcttctctaccatggaaaaaaccaaaatcgagtcgaatcttaagattcatttctgagtttcaacaatcaccgttcgttgaaactggctttccaacttctctgatcgatctcttcttcaagaatcgcgatcgtctaaaaaaatctccatctaaacgcttccaacgaatcgaacgccagattcgaaccgctccaaacgcttcttcgttgagtaatcaagatacgatttttgaaaagccctcgaggattaaaaccgttcgaagtaaggtcgagaaagttaattgcgttaaaggtaaatcagcggcgttgaagaagaacgcgattaaaaatagcgttttcggcggtagcggtgaggtcgttttgatggcgtttaaggttttgatagtagcgttgctcgccttgagcacgaagaagaagctcactttaggaatcactctctctgccttcgctcttctcttaacagagctcgtggcggcgcgtgttttcacgcgctctaataacaccgacaaagacaaaaacgcgattgcccgcgagaaaatcgaaacttttgatgaaactcgagttcccaaagcgattccatgtcctgaggaaacagagcatgtagtatctgaaacagaggtttcgaagttgaaaggtttaacgatacgtgatctgttgtcaaaggacgagaaatcaacaagtaaaagttggagactaaaatcgaagattgtgaagaagttgaggagttacaataagaaggataagaagacgatgaagatcaaagaagagtctttgattgaagtctcgagtttggttttagaagataaaccaaagaaaattgagtctgagagagacgaagaagaaacgttgaatcctccagtggttggatcaaacctgaatgggattgttctgatcgtgattgtgctaaccggtttgttatgtgggaaggtcttagctattgttctgacactatcatgtttggttcttagattaggagcagtcaaaaaagttaatctttgcatataattttttttgtattttttaacatgcttgcatgtgaaactgtaaatttttctcattcatatgaaggagattggattgaatgttgaatactaaa

SEQ ID NO: 2622 - protein, 334 aa, Arabidopsis thaliana
  G1447
MSSLPWKKPKSSRILRFISEFQQSPFVETGFPTSLIDLFFKNRDRLKKSPSKRFQRIERQIRTAPNASSLSNQDTIFEKPSRIKTVRSKVEKVNCVKGKSAALKKNAIKNSVFGGSGEVVLMAFKVLIVALLALSTKKKLTLGITLSAFALLLTELVAARVFTRSNNTDKDKNAIAREKIETFDETRVPKAIPCPEETEHVVSETEVSKLKGLTIRDLLSKDEKSTSKSWRLKSKIVKKLRSYNKKDKKTMKIKEESLIEVSSLVLEDKPKKIESERDEEETLNPPVVGSNLNGIVLIVIVLTGLLCGKVLAIVLTLSCLVLRLGAVKKVNLCI

SEQ ID NO: 2623 - DNA, 983 bp, Arabidopsis thaliana
  G1453
cgtcgacgcgaaataaatcctagaaaataactatcaatatgatgaaggttgatcaagattattcgtgtagtataccgcctggatttaggtttcatccgacagatgaagaacttgtcggatattatctcaagaagaaaatcgcctcccagaggattgatctcgacgttatcagagaaattgatctttacaagatcgaaccatgggatctacaagagagatgtaggatagggtacgaggagcaaacggagtggtatttcttcagccatagagacaagaagtatccgactgggactaggacaaaccgagccaccgtggccggtttctggaaagcaacgggccgggacaaggcggtttacctcaactccaaacttatcggtatgagaaaaacgcttgtcttttaccgaggtcgagcgcctaatggccaaaagtccgattggatcattcacgaatactacagcctcgagtcacaccagaactctcctccacaggaagaaggatgggtagtgtgtagagcatttaagaaacgaacgaccatcccaacaaaaaggaggcaactttgggatccgaactgcttattctacgacgacgccactctcttggaacctctcgacaagcgagccagacataatcctgattttaccgccacaccgttcaagcaagaactactctccgaggccagtcacgtccaggatggagatttcggatctatgtaccttcaatgcatcgatgatgatcaattctcccagcttcctcagctcgagagcccctctcttccgtcggaaataactccccatagtactactttttctgagaacagtagccggaaagatgacatgagctccgagaagaggatcactgactggagatatctagataagttcgtggcgtctcaatttttgatgagtggagaagactaaaaaaggctttcctatgcatgcatgcactagaaacgtcgtcgcattttggatttacatgcggccgct

SEQ ID NO: 2624 - protein, 292 aa, Arabidopsis thaliana
  G1453
MMKVDQDYSCSIPPGFRFHPTDEELVGYYLKKKIASQRIDLDVIREIDLYKIEPWDLQERCRIGYEEQTEWYFFSHRDKKYPTGTRTNRATVAGFWKATGRDKAVYLNSKLIGMRKTLVFYRGRAPNGQKSDWIIHEYYSLESHQNSPPQEEGWVVCRAFKKRTTIPTKRRQLWDPNCLFYDDATLLEPLDKRARHNPDFTATPFKQELLSEASHVQDGDFGSMYLQCIDDDQFSQLPQLESPSLPSEITPHSTTFSENSSRKDDMSSEKRITDWRYLDKFVASQFLMSGED

SEQ ID NO: 2625 - DNA, 1272 bp, Arabidopsis thaliana
  G1459
atgatgaaaggtctgattgggtatagatttagtccgacgggagaggaagtgatcaaccattacctaaagaacaaacttctgggtaagtattggctcgttgatgaagctattagcgagatcaacatcttgagtcacaaacccagcaaggatttgcctaagttagctaggatccaatcggaagatcttgaatggtatttcttctctccgattgagtacacgaacccgaataagatgaaaatgaagaggacgacaggttctgggttttggaaacctactggtgttgatcgggaaattagggataaaagaggaaatggtgttgtgatagggattaagaagacgcttgtgtaccatgaaggtaagagtcctcatggagttagaactccttgggttatgcacgagtatcacatcacttgcttgcctcatcataagaggaaatatgttgtctgccaagtaaagtataagggtgaagctgcagaaatttcatatgagccaagtccctctttggtatccgattcgcataccgtcatagcgattaccggagaaccggaacctgagcttcaggttgagcagccaggtaaagaaaatctcttgggtatgtctgtagatgatttgatagaaccaatgaaccaacaagaggagccacaaggtcctcacttagctccgaatgatgatgagtttatacgtggattgaggcatgttgatcgagggacggttgaatatttgtttgccaatgaagaaaacatggatggtttgtctatgaatgacttgagaatcccaatgatcgtccaacaagaggatctctctgagtgggagggatttaacgcagacacctttttcagcgacaacaacaataactataaccttaacgtgcatcatcaactaacgccttacggcgatggctatttgaatgcattttcgggttataacgaagggaatcctcccgatcacgaattagtgatgcaagagaaccgcaacgatcacatgccaaggaaacctgtgacagggaccattgattatagcagcgatagtggcagtgatgctggatccatatctacaacggtgaaacaagaaatcccaagagctgttgatgcacccatgaacaatgagtcatctttggtgaaaacagagaagaaaggcttgtttattgtagaggacgcaatggagagaaaccgcaagaaaccacgatttatctatctcatgaagatgatcataggcaacatcatatcggttttactacccgtcaaaagattgatcccggtgaagaagttatga

SEQ ID NO: 2626 - protein, 423 aa, Arabidopsis thaliana
  G1459
MMKGLIGYRFSPTGEEVINHYLKNKLLGKYWLVDEAISEINILSHKPSKDLPKLARIQSEDLEWYFFSPIEYTNPNKMKMKRTTGSGFWKPTGVDREIRDKRGNGVVIGIKKTLVYHEGKSPHGVRTPWVMHEYHITCLPHHKRKYVVCQVKYKGEAAEISYEPSPSLVSDSHTVIAITGEPEPELQVEQPGKENLLGMSVDDLIEPMNQQEEPQGPHLAPNDDEFIRGLRHVDRGTVEYLFANEENMDGLSMNDLRIPMIVQQEDLSEWEGFNADTFFSDNNNNYNLNVHHQLTPYGDGYLNAFSGYNEGNPPDHELVMQENRNDHMPRKPVTGTIDYSSDSGSDAGSISTTVKQEIPRAVDAPMNNESSLVKTEKKGLFIVEDAMERNRKKPRFIYLMKMIIGNIISVLLPVKRLIPVKKL

SEQ ID NO: 2627 - DNA, 1034 bp, Arabidopsis thaliana
  G1460
  misc_feature (1029)..(1029): n is a, c, g, or t
cgtcgaccttcactcaaaccctaatcccgggaacccgggaattttgatcattttgtttcttttcgatctgtttctattttaaaaagatgatgaaagatccgactgggtatagatttagtccgacgggagaggaagtgataaaccattacctaaagaacaaaattctgggtaagacttggctcgttgatgaagccattagcgagatcaacatcttgaatcacaaacccagcaaggatttgcctaagttagctaggatccaatcggaagatcttgagtggtactttttctctccgattgagtacacgaacccgaataagatgaaaatgaagaggacgacaggttctgggttttggaaacctagtggtgttgatcggaaaattagggataaaagaggaaatggtgttgtgatagggattaagaagacgcttgtgtaccatgaaggtaagagtcctcatggagttagaactccttgggttatgcacgagtatcacatcacttgcttgcctcatcataagaggaaatatgttgtctgccaagtaaagtataagggtgaagctgcagaaatttcatatgagccaagtccctctttggtatccgattcgcataccgtcatagcgattaacggagaaccggaacctgagcttcaggttgagcagccaggtaaagaaaatctcttgggtatgtctgtagatgatttgatagaaccaatgaaccaacaagaggagccacaaggtcctcacttagctccgaatgatgatgagtttatacgtggattgagacatgttgatcgagagccggttgaatatttgtttgccaatgaagaaaacatggatggtttgtctattatgaatgacttgacaatcccaatgatcgcccaacaagaggatctcattctctctgagtgggagggatttatcgcagccacctttttcagcgacaacaacaataacaataaccttaacgtgcatcaactaacgtctttcttaccgggatgattatcagaatgcattttgggttacaacggagcgnccgct

SEQ ID NO: 2628 - protein, 302 aa, Arabidopsis thaliana
  G1460
MMKDPTGYRFSPTGEEVINHYLKNKILGKTWLVDEAISEINILNHKPSKDLPKLARIQSEDLEWYFFSPIEYTNPNKMKMKRTTGSGFWKPSGVDRKIRDKRGNGVVIGIKKTLVYHEGKSPHGVRTPWVMHEYHITCLPHHKRKYVVCQVKYKGEAAEISYEPSPSLVSDSHTVIAINGEPEPELQVEQPGKENLLGMSVDDLIEPMNQQEEPQGPHLAPNDDEFIRGLRHVDREPVEYLFANEENMDGLSIMNDLTIPMIAQQEDLILSEWEGFIAATFFSDNNNNNNLNVHQLTSFLPG

SEQ ID NO: 2629 - DNA, 645 bp, Arabidopsis thaliana
  G1475
atgaagagaacacatttggcaagttttagtaacagagacaaaacccaagaagaagaaggagaagacggtaatggtgacaacagagtcatcatgaatcactacaagaattacgaagctgggctgatcccatggcctcccaagaattacacttgcagcttctgcaggagagagttcagatctgctcaagcacttggaggccacatgaatgttcatagaagagacagagcaaaactcaggcagatcccttcttggctcttcgaacctcaccaccacacacctattgcaaaccctaaccctaattttagctcttcttcttcctcttcaacaacaacagctcatcttgagccttccctaaccaaccagagatccaaaaccactccttttccttctgcccggtttgatcttttggacagtactactagctatggaggtttgatgatggacagagagaagaacaagagcaatgtatgtagcagagagatcaagaaaagtgccatcgatgcatgtcattcagtaagatgtgagataagccgtggggatctgatgaataagaaagatgatcaagtcatggggttggagcttgggatgagtttgaggaatcccaaccaagttcttgatttggagcttcgactaggctacctctaa

SEQ ID NO: 2630 - protein, 214 aa, Arabidopsis thaliana
  G1475
MKRTHLASFSNRDKTQEEEGEDGNGDNRVIMNHYKNYEAGLIPWPPKNYTCSFCRREFRSAQALGGHMNVHRRDRAKLRQIPSWLFEPHHHTPIANPNPNFSSSSSSSTTTAHLEPSLTNQRSKTTPFPSARFDLLDSTTSYGGLMMDREKNKSNVCSREIKKSAIDACHSVRCEISRGDLMNKKDDQVMGLELGMSLRNPNQVLDLELRLGYL

SEQ ID NO: 2631 - DNA, 606 bp, Arabidopsis thaliana
  G1477
atgttgtcctcggactcgaattacgctagtgatattagcgacgatgcctccgccaccggatcgatagagaatcctatatacaaatgcaagtattgtcctaggaagttcgataaaacacaagcattaggtggtcatcaaaatgcacacagaaaggagagagaggtcgaaaaacaacaaaaagcatttttggcgcatttgaaccgaccagaaccagatctttacgcgtactcgtattcgtatcatcattcatttcctaaccaatacgcactcccaccgggatttgaacagcctcagtacaaagttgatagatcatacaagatgtccatggtctacaaccaatatgtgggatcctcaagctctagctttgcaggactacaaagtgacccaagtcaaggaatgaaccaggattggacctttaccgggatcccattcctaccccaatctcaacctcaaccactatcgtcaccaatatgtttggatctttgccttggcattggtagctcccaaacccaaccacaacctcaagaaccaaatgatgcaacagaagagatggatgctgagaaagaaaatgatggttcttccctttctctctcactcaaactgtga

SEQ ID NO: 2632 - protein, 201 aa, Arabidopsis thaliana
  G1477
MLSSDSNYASDISDDASATGSIENPIYKCKYCPRKFDKTQALGGHQNAHRKEREVEKQQKAFLAHLNRPEPDLYAYSYSYHHSFPNQYALPPGFEQPQYKVDRSYKMSMVYNQYVGSSSSSFAGLQSDPSQGMNQDWTFTGIPFLPQSQPQPLSSPICLDLCLGIGSSQTQPQPQEPNDATEEMDAEKENDGSSLSLSLKL

SEQ ID NO: 2633 - DNA, 1020 bp, Arabidopsis thaliana
  G1487
atggaacaagccgcgttgaagagcagcgtcaggaaagagatggctctcaaaacgacttctccggtttacgaagagtttcttgccgtcaccaccgctcaaaatggcttttccgtcgacgatttctctgtagacgacttgcttgacttgtcaaacgatgacgtttttgccgacgaagaaactgacctcaaggctcaacatgagatggtccgtgtttcctctgaggaacccaacgacgacggagacgctcttcgccggagcagcgatttctccggctgtgacgactttggttctctccctacaagcgaactctctcttccggcggatgatttagcgaaccttgagtggctctctcatttcgtggaggactccttcacggaatattcgggtccaaacctcaccggaaccccgactgagaaaccggcgtggttaacgggtgaccggaaacatcctgtgactgcagtcacggaagagacctgtttcaaatcccctgttccggctaaagcccgtagcaaacgtaaccgcaatggcctcaaggtctggtcgcttggttcgtcgtcctcctcgggtccttcctcgtccggttcgacctcctcctcctcttcgggtccttccagcccgtggttctccggcgctgagctgctcgagcctgtggtcacgtcagagaggccaccgtttcccaagaagcataagaaaaggtcagccgagtctgttttctccggtgagctgcagcagctgcaacctcagcgaaagtgcagccactgcggcgttcagaaaactccgcagtggagagccgggccaatgggagccaagaccctgtgcaatgcgtgcggtgtccggtacaagtcgggtaggttgctaccggaatacagacccgcttgtagcccgacattctcgagtgagctgcactcgaaccaccaccggaaagtcatagagatgaggcggaagaaggagccaaccagtgacaacgaaaccggtttaaaccagctggttcagtccccacaagctgtaccaagtttttga

SEQ ID NO: 2634 - protein, 339 aa, Arabidopsis thaliana
  G1487
MEQAALKSSVRKEMALKTTSPVYEEFLAVTTAQNGFSVDDFSVDDLLDLSNDDVFADEETDLKAQHEMVRVSSEEPNDDGDALRRSSDFSGCDDFGSLPTSELSLPADDLANLEWLSHFVEDSFTEYSGPNLTGTPTEKPAWLTGDRKHPVTAVTEETCFKSPVPAKARSKRNRNGLKVWSLGSSSSSGPSSSGSTSSSSSGPSSPWFSGAELLEPVVTSERPPFPKKHKKRSAESVFSGELQQLQPQRKCSHCGVQKTPQWRAGPMGAKTLCNACGVRYKSGRLLPEYRPACSPTFSSELHSNHHRKVIEMRRKKEPTSDNETGLNQLVQSPQAVPSF

SEQ ID NO: 2635 - DNA, 1069 bp, Arabidopsis thaliana
  G1492
aatcccaacccacacacctctcaaatcctcctctcctcgtttctctttctctcctcttcacagaaccaaaacatatcaaacctttttttctcttgggtttaagtaaaaatcgaatctttgtgtcggtttttagggttcttgaaacgatatgggtaagtctagtggtagaaatggtaacggaagctttaacggcaataaatttcacggagttagaccttacgtacggtctccagttccacggcttagatggacgccggatcttcaccgttgtttcgttcacgccgtcgagattctcggtggtcaacaccgagcaacaccaaaacttgttcttaagatgatggatgtgaagggacttaccatttcacatgtcaaaagccaccttcagatgtatagaggaggttcaaagctcactttggagaaaccagaagaaagctcatcatcttcaataagaagaagacaagacagtgaagaagattattatcttcatgacaacttgtctttacacacaaggaatgattgtcttttgggttttcactcttttcctctttcttcacattcttcatttagaggaggaggaggaggaagaacaaaagagcagcagacttcagagtctggtggttatgatgatgatgctgactttcttcacatcaagaagatgaacgatacgacgacgtttttgtcacatcatttccccaagggaacagaggagtggcgggaacaagaacacgaagaagaagaagaagatttgtcgttgtctctgtcgttaaatcatcatcattggagaagcaatggatcatcggtggtgagcgaaacgagtgaagcagcagtctcgacttgttcagcaccattcgtatccaaagattgctttggttcttcaaagattgatcttaatctgtcaatttctctcctcggtagctaaataagttatgcaagatttaggttcagagaaactattcggatgtgtttttgaaactaggatattgaatgttagtagagaaacctagaaaatgaagtttagataaattatcaacgcagcgttttgatcgcctttgaacggaaaattaacaaa

SEQ ID NO: 2636 - protein, 256 aa, Arabidopsis thaliana
  G1492
MGKSSGRNGNGSFNGNKFHGVRPYVRSPVPRLRWTPDLHRCFVHAVEILGGQHRATPKLVLKMMDVKGLTISHVKSHLQMYRGGSKLTLEKPEESSSSSIRRRQDSEEDYYLHDNLSLHTRNDCLLGFHSFPLSSHSSFRGGGGGRTKEQQTSESGGYDDDADFLHIKKMNDTTTFLSHHFPKGTEEWREQEHEEEEEDLSLSLSLNHHHWRSNGSSVVSETSEAAVSTCSAPFVSKDCFGSSKIDLNLSISLLGS

SEQ ID NO: 2637 - DNA, 681 bp, Arabidopsis thaliana
  G1505
atggatgatatagcggaacttgaatggttatcaaatttcgtagatgattcttctttcacgccgtattctgctccgacgaataaaccggtttggttaaccggaaatcggagacatcttgtacaaccggttaaagaggagacctgcttcaaatcccaacatccggccgtcaaaaccagacccaaacgagccagaaccggagtcagagtctggtctcatggttcgcagtcgttaaccgactcatcttcaagctctacaacatcttcgtcgtcctctcctcgtccttcaagccctctatggctcgccagcggtcagtttcttgatgagccaatgactaaaacacaaaagaagaagaaagtttggaaaaacgctggtcagacgcaaacgcaaacgcagacgcagacgcggcagtgtggtcattgtggagttcagaaaacgccgcagtggagagcaggaccattaggagcgaagacgttgtgtaatgcgtgtggtgtgcgttacaaatcgggtcggttactacccgaatatagacccgcttgtagcccaacattttcgagtgagcttcactcaaaccaccacagtaaagtcattgagatgcgtaggaagaaagagacttctgacggtgctgaagaaaccggtttgaaccagccggttcagacggttcaggttgtctcgagtttttga

SEQ ID NO: 2638 - protein, 226 aa, Arabidopsis thaliana
  G1505
MDDIAELEWLSNFVDDSSFTPYSAPTNKPVWLTGNRRHLVQPVKEETCFKSQHPAVKTRPKRARTGVRVWSHGSQSLTDSSSSSTTSSSSSPRPSSPLWLASGQFLDEPMTKTQKKKKVWKNAGQTQTQTQTQTRQCGHCGVQKTPQWRAGPLGAKTLCNACGVRYKSGRLLPEYRPACSPTFSSELHSNHHSKVIEMRRKKETSDGAEETGLNQPVQTVQVVSSF

SEQ ID NO: 2639 - DNA, 1413 bp, Arabidopsis thaliana
  G1506
atggggaagcaaggtccttgctatcactgtggagttacaagtacacctctatggagaaacgggccaccagagaagccggtgttgtgcaatgcgtgtggttcgaggtggagaactaaaggatcattagtaaactacacacctcttcatgctcgtgctgaaggtgatgagactgagattgaggatcatagaactcaaacggtgatgattaagggaatgtctttgaacaaaaagattcccaagaggaaaccatatcaagaaaacttcacagtgaaaagagctaacttggaattccataccggtttcaagaggaaggctctggatgaagaagctagcaatagatcgagttcaggatcggttgtatcaaactccgagagctgtgcacaatctaatgcgtgggactcgacttttccttgtaagagaaggacatgtgtgggacgtccaaaggcagcttcttctgttgaaaagctcacaaaggatctttatactattctacaagaacagcaatcttcttgtctctctggtacttcagaggaagatttgctttttgagaatgaaacaccaatgctgttaggacatggtagtgttcttatgagagatcctcactcaggtgctcgagaagaggaatctgaagctagctcactcttagttgagagcagcaagtcttcatcagttcattctgttaaatttggtggaaaagcaatgaagcaggagcaagtgaagaggagcaaatctcaagtcttaggaagacatagttcactactctgtagcatagatttgaaggatgttttcaactttgatgagttcatagaaaatttcacagaggaagaacagcaaaaactgatgaaattacttcctcaagttgactctgttgatcgtcctgatagcctcagaagcatgtttgagagttctcaattcaaagagaacttatccttgtttcagcaacttgtggcagatggtgtttttgagacaaattcgtcttatgcaaaacttgaagacattaagacacttgcaaagcttgctttatcagatcctaacaaatcccatttgttggaaagctattacatgctcaagagaagagagattgaagactgtgttactacaacatcaagggtctcaagcttgagtccatcgaataataatagtcttgtaaccattgaaagaccttgtgaaagcttaaaccaaaacttctcagagacaagaggtgtgatgagaagcccgaaagaagtgatgaagattagatcaaagcacaccgaagagaatttagagaatagtgtatcttcctttaaacctgtgagctgtggtggacctctggtgtttagctatgaagataatgatatttctgatcaggatcttcttcttgatgtgccgtcgaacggctcattccctcaagcagagcttctaaacatgatatga

SEQ ID NO: 2640 - protein, 470 aa, Arabidopsis thaliana
  G1506
MGKQGPCYHCGVTSTPLWRNGPPEKPVLCNACGSRWRTKGSLVNYTPLHARAEGDETEIEDHRTQTVMIKGMSLNKKIPKRKPYQENFTVKRANLEFHTGFKRKALDEEASNRSSSGSVVSNSESCAQSNAWDSTFPCKRRTCVGRPKAASSVEKLTKDLYTILQEQQSSCLSGTSEEDLLFENETPMLLGHGSVLMRDPHSGAREEESEASSLLVESSKSSSVHSVKFGGKAMKQEQVKRSKSQVLGRHSSLLCSIDLKDVFNFDEFIENFTEEEQQKLMKLLPQVDSVDRPDSLRSMFESSQFKENLSLFQQLVADGVFETNSSYAKLEDIKTLAKLALSDPNKSHLLESYYMLKRREIEDCVTTTSRVSSLSPSNNNSLVTIERPCESLNQNFSETRGVMRSPKEVMKIRSKHTEENLENSVSSFKPVSCGGPLVFSYEDNDISDQDLLLDVPSNGSFPQAELLNMI

SEQ ID NO: 2641 - DNA, 420 bp, Arabidopsis thaliana
  G1508
atgctagatcacagtgaaaaggtcttattggttgattcagaaaccatgaaaacaagagctgaagatatgatcgaacagaacaacactagtgttaacgacaagaagaagacttgtgctgattgtggaaccagtaaaactcctctttggcgtggtggtcctgttggtccaaagtcgttgtgtaacgcgtgtgggatcagaaacagaaagaagagaagaggaggaacagaagataataagaaattaaagaaatcgagttctggcggcggaaaccgtaaatttggtgaatcgttaaaacagagtttgatggatttggggataaggaagagatcaacggtggagaagcaacgacagaagcttggtgaagaagaacaagccgctgtgttactcatggctctttcttatggctctgtttacgcttag

SEQ ID NO: 2642 - protein, 139 aa, Arabidopsis thaliana
  G1508
MLDHSEKVLLVDSETMKTRAEDMIEQNNTSVNDKKKTCADCGTSKTPLWRGGPVGPKSLCNACGIRNRKKRRGGTEDNKKLKKSSSGGGNRKFGESLKQSLMDLGIRKRSTVEKQRQKLGEEEQAAVLLMALSYGSVYA

SEQ ID NO: 2643 - DNA, 732 bp, Arabidopsis thaliana
  G1512
atggaagggaacttcttcatcaggtctgatgctcaacgagcacatgacaatggcttcatagccaaacaaaaacctaatctcaccacggctccaacagcaggtcaagctaatgaaagtggctgttttgactgcaacatctgtttagacacagcccatgatccggtggtcactctctgcgggcaccttttctgctggccttgcatttacaagtggttacatgttcagttatcttctgtctccgttgatcagcaccagaacaattgccctgtttgtaaatccaacattactatcacctctttggttcctctctatggaagaggcatgtcttcgccttcttccacgtttggctccaagaaacaagacgcactgtccactgacataccccgcagacctgctccatcagccttacgcaatccgattacctcagcatcatctctgaacccaagcttgcaacatcaaactctgtctccttcatttcataatcatcagtattcccctcgtggcttcaccacaaccgaatcaaccgaccttgccaatgctgtaatgatgagtttcctctaccctgtgattggaatgtttggagacctggtctacaccaggatattcgggaccttcacaaacacaatagctcagccttaccaaagccagaggatgatgcagcgtgagaagtctcttaatcgggtatcgatattcttcctttgttgcatcatcctttgcctccttctcttctag

SEQ ID NO: 2644 - protein, 243 aa, Arabidopsis thaliana
  G1512
MEGNFFIRSDAQRAHDNGFIAKQKPNLTTAPTAGQANESGCFDCNICLDTAHDPVVTLCGHLFCWPCIYKWLHVQLSSVSVDQHQNNCPVCKSNITITSLVPLYGRGMSSPSSTFGSKKQDALSTDIPRRPAPSALRNPITSASSLNPSLQHQTLSPSFHNHQYSPRGFTTTESTDLANAVMMSFLYPVIGMFGDLVYTRIFGTFTNTIAQPYQSQRMMQREKSLNRVSIFFLCCIILCLLLF

SEQ ID NO: 2645 - DNA, 1233 bp, Arabidopsis thaliana
  G1514
atggccgaaactatgaaagatattacgatgaagaacgatgaatcacaggaagaagaaatccccgatcaatttctctgctgcgtttgcctggaacttctttacaagccaattgtgttatcttgtggtcatctatcatgtttttggtgcgtacataagtccatgaatggctttcgtgagtctcattgtccgatatgtagagacccgtatgttcactttccctctgtgtgccagaagctttattttctgttaaagaagatgtacccacttgctcataagaagagagaagaacaagttttaaaggaagagcaagaacgagaatgtttttctcctcagattgatcttgttttggatttgtctgtgtgtagtggagattctctcaatgtctctgataaacagaaggtggaagagtgttcgaatgcagcgaacttattatctagttcatcaagtagaggtgacattccatgtatccccaaaaatcaagaacccacagatgcaaaagctcttaatgttcatgaaaatgaattacttaaggataacaaagtcagtaagcagatttcgaaagatgatttgctctgttcagcatgtaaggagctgcttgtacgacccgtagttctcaattgcggacatgtgtattgtgaaggatgtgtagtagatatggctgaagaaagcgaaaagatcaaatgtcaagagtgtaatgtttgtgacccaagaggatttccaaaagtttgtttgattcttgaacagcttttggaggaaaactttcctgaagaatacaattcaagaagcagtaaggttcagaaaacgctcgcccataatagcaaaggaaatattcaaagctatctcaaagaaggcccgtccttatcaaacgacaataacaatgatgatccctggttggcaaaccctggatcaaatgttcactttggagctggttgtgattcttgtggggtgtatccaatcataggggatcgatacagatgcaaagactgcaaggaggaaattgggtatgacctttgcaaagactgttacgagactccttcgaaagttccagggagattcaaccagcaacacactcctgaccacaggcttgagcttgcacggtctcctcaggttctgatcaatttcaattctatcggtatccttctcggacccgttatctcaaatgaaggcatggatacagatgaaggcgaggaagggcctcctggttcttctaatgagtcatcaagcacagaatga

SEQ ID NO: 2646 - protein, 410 aa, Arabidopsis thaliana
  G1514
MAETMKDITMKNDESQEEEIPDQFLCCVCLELLYKPIVLSCGHLSCFWCVHKSMNGFRESHCPICRDPYVHFPSVCQKLYFLLKKMYPLAHKKREEQVLKEEQERECFSPQIDLVLDLSVCSGDSLNVSDKQKVEECSNAANLLSSSSSRGDIPCIPKNQEPTDAKALNVHENELLKDNKVSKQISKDDLLCSACKELLVRPVVLNCGHVYCEGCVVDMAEESEKIKCQECNVCDPRGFPKVCLILEQLLEENFPEEYNSRSSKVQKTLAHNSKGNIQSYLKEGPSLSNDNNNDDPWLANPGSNVHFGAGCDSCGVYPIIGDRYRCKDCKEEIGYDLCKDCYETPSKVPGRFNQQHTPDHRLELARSPQVLINFNSIGILLGPVISNEGMDTDEGEEGPPGSSNESSSTE

SEQ ID NO: 2647 - DNA, 891 bp, Arabidopsis thaliana
  G1521
atgcctccattaccgtcctccacggcgccttcgtcttcgagacatcttcgatcgccggaaagtatcgcgaaatttgcagggagagcaatatttcctgctttacaggggaaatcgtgtccgatatgcctcgaaaatctaaccgagcgaagatccgccgccgtgatcacggtgtgcaagcacggatactgccttgcttgtattcggaagtggagcagcttcaagaggaattgtcctctttgtaacactcgttttgattcctggtttatcgttagtgattttgcttctagaaaataccataaggagcaattaccaattcttcgtgatcgtgagactttaacttatcatcggaataatccttccgatcgccggaggataattcaaaggtcgagggatgttttggaaaactctagctcaagatcaaggccattgccatggcggagatcatttggacgaccaggttcagttcctgattctgttatcttccagcgaaagcttcagtggcgagctagcatatacactaagcaattacgagctgttcgattacattcaaggcgcttggaactaagtttggcggtgaatgattacaccaaagcaaagataactgaaagaattgagccatggattagaagagagcttcaggcagtccttggagatcctgatccctcagttattgttcattttgcgtcagctcttttcatcaaaaggcttgagagagagaataatcgacaaaccgggcagaccgggatgttggtggaagatgaagtctcctctcttcgaaaattcttgtctgataaggtggatatattttggcatgaactaagatgttttgcggagagtatactcacgatggagacttatgatgcagtggttgaatacaatgaggtggagtaa

SEQ ID NO: 2648 - protein, 296 aa, Arabidopsis thaliana
  G1521
MPPLPSSTAPSSSRHLRSPESIAKFAGRAIFPALQGKSCPICLENLTERRSAAVITVCKHGYCLACIRKWSSFKRNCPLCNTRFDSWFIVSDFASRKYHKEQLPILRDRETLTYHRNNPSDRRRIIQRSRDVLENSSSRSRPLPWRRSFGRPGSVPDSVIFQRKLQWRASIYTKQLRAVRLHSRRLELSLAVNDYTKAKITERIEPWIRRELQAVLGDPDPSVIVHFASALFIKRLERENNRQTGQTGMLVEDEVSSLRKFLSDKVDIFWHELRCFAESILTMETYDAVVEYNEVE

SEQ ID NO: 2649 - DNA, 825 bp, Arabidopsis thaliana
  G1524
atggggagaactaaggagcaggcaacattaactcggtatccaccctgtcctaggaatcctgctaaattcaatgatataaacaaagcactccaggaaaaaggatatggtaaggctctgaaaagaaaaccttggacgggtgtgacatgccctgtctgtcttgaggttcctcacaactcggtcgtcctcctttgttcatcttaccacaaaggatgccgtccgtacatgtgtgccacgggaaaccgtttctcaaattgtctagagcagtacaaaaaggcatatgccaaggatgagaaaagtgacaaaccgccagagctattgtgcccgctttgtaggggtcaggtgaaaggctggaccgttgtggaaaaggaacgtaagtatctgaattctaagaaaaggtcatgcatgaacgacgagtgtttgttttatggaagctatagacagctcaagaagcatgttaaggagaaccatccgagagccaagccaagagccatagaccctgtgctggaggcgaaatggaagaagcttgaggttgagagggagaggagtgatgtaatcagcacagtcatgtcgtcaacacctggggctatggtatttggagactatgtgattgagccatacaatggttatgatcatcaagatgacagtgacgattacagtgattcgtcggatgacgaaatggaaggtggggtattcgagcttggagcattcgacctgggccgtcttcaaccgcgttcggctgccatctcaagccggggaattcgcggtatgatcataaggaaccggtgggctcgaagcagaggtgcgagcagaaggcgacaaacataa

SEQ ID NO: 2650 - protein, 274 aa, Arabidopsis thaliana
  G1524
MGRTKEQATLTRYPPCPRNPAKFNDINKALQEKGYGKALKRKPWTGVTCPVCLEVPHNSVVLLCSSYHKGCRPYMCATGNRFSNCLEQYKKAYAKDEKSDKPPELLCPLCRGQVKGWTVVEKERKYLNSKKRSCMNDECLFYGSYRQLKKHVKENHPRAKPRAIDPVLEAKWKKLEVERERSDVISTVMSSTPGAMVFGDYVIEPYNGYDHQDDSDDYSDSSDDEMEGGVFELGAFDLGRLQPRSAAISSRGIRGMIIRNRWARSRGASRRRQT

SEQ ID NO: 2651 - DNA, 666 bp, Arabidopsis thaliana
  G1531
atgtgtgagtcaagcaacaaagtcagagtatcgccatacccgcttcggtcttcgaggaccgacaaacacaaggcgtcagagtcgcctattgagacaggttgggaggatgtgcgtggatgtcatccttacatgtgcgatacgagtgttcgtcactccaattgtttcaagcagttccgcagaaaaaccataaaaaagcgcctataccccaagaccttacattgtcctctctgtagaggtgaagtatccgagacgacaaaggtgacgagcactgcaagaagatttatgaatgctaaaccgaggtcttgctccgtagaggattgcaaattctctgggacgttttctcagcttactaagcacttgaaaactgagcatcgcggtattgtgccaccaaaggtcgatccactgagacaacagagatgggaaatgatggagagacattctgaatacgttgaactcatgactgcagctgggatttcgcgtatggctgaggtgatgcaacaacagcttccccaggatcagaatcatcctcatgtgtttcaagtgaccgttaatggaaccatatggaatctaattgatccgagtcagggaaggaatggattaggcatcaccaactatagcgcaatgcagtttgtaccattaagcataaatcacagtagaactctgtga

SEQ ID NO: 2652 - protein, 221 aa, Arabidopsis thaliana
  G1531
MCESSNKVRVSPYPLRSSRTDKHKASESPIETGWEDVRGCHPYMCDTSVRHSNCFKQFRRKTIKKRLYPKTLHCPLCRGEVSETTKVTSTARRFMNAKPRSCSVEDCKFSGTFSQLTKHLKTEHRGIVPPKVDPLRQQRWEMMERHSEYVELMTAAGISRMAEVMQQQLPQDQNHPHVFQVTVNGTIWNLIDPSQGRNGLGITNYSAMQFVPLSINHSRTL

SEQ ID NO: 2653 - DNA, 783 bp, Arabidopsis thaliana
  G1537
atggaaaacgaagtaaacgcaggaacagcaagcagttcaagatggaacccaacgaaagatcagatcacgctactggaaaatctttacaaggaaggaatacgaactccgagcgccgatcagattcagcagatcaccggtaggcttcgtgcgtacggccatatcgaaggtaaaaacgtcttttactggttccagaaccataaggctaggcaacgccaaaagcagaaacaggagcgcatggcttacttcaatcgcctcctccacaaaacctcccgtttcttctacccccctccttgctcaaacgtgggttgtgtcagtccgtactatttacagcaagcaagtgatcatcatatgaatcaacatggaagtgtatacacaaacgatcttcttcacagaaacaatgtgatgattccaagtggtggctacgagaaacggacagtcacacaacatcagaaacaactttcagacataagaacaacagcagccacaagaatgccaatttctccgagttcactcagatttgacagatttgccctccgtgataactgttatgccggtgaggacattaacgtcaattccagtggacggaaaacactccctctttttcctcttcagcctttgaatgcaagtaatgctgatggtatgggaagttccagttttgcccttggtagtgattctccggtggattgttctagcgatggagccggccgagagcagccgtttattgatttcttttctggtggttctacttctactcgtttcgatagtaatggtaatgggttgtaa

SEQ ID NO: 2654 - protein, 260 aa, Arabidopsis thaliana
  G1537
MENEVNAGTASSSRWNPTKDQITLLENLYKEGIRTPSADQIQQITGRLRAYGHIEGKNVFYWFQNHKARQRQKQKQERMAYFNRLLHKTSRFFYPPPCSNVGCVSPYYLQQASDHHMNQHGSVYTNDLLHRNNVMIPSGGYEKRTVTQHQKQLSDIRTTAATRMPISPSSLRFDRFALRDNCYAGEDINVNSSGRKTLPLFPLQPLNASNADGMGSSSFALGSDSPVDCSSDGAGREQPFIDFFSGGSTSTRFDSNGNGL

SEQ ID NO: 2655 - DNA, 2178 bp, Arabidopsis thaliana
  G1544
atgtctcagtcaaacatggtaccagtggctaacaacggagacaacaacaacgacaacgaaaacaacaacaacaacaacaacaatggtggaactgacaacactaatgctggaaatgattctggagatcaagatttcgacagtgggaatacctcaagtggcaatcatggagaagggttgggaaacaatcaagctcctcgtcataagaagaaaaaatacaatcgtcacacccaacttcagatttcggagatggaagctttcttcagagagtgtcctcacccagatgacaaacaaaggtacgaccttagcgctcaattgggattggaccctgttcagatcaaattctggttccagaacaaacgcactcaaaacaagaatcaacaagaacgctttgagaactcagaacttcggaatctgaacaaccaccttaggtctgaaaatcagcggttacgagaagctattcatcaagccttatgccctaagtgtggaggccaaactgcaattggcgaaatgaccttcgaagagcaccatcttcgcatcctcaacgctcgtttgactgaagagatcaagcaactttccgtgacagcggaaaagatatcaaggcttacggggataccagtaaggagccatccccgtgtgtctcctcctaatcctcctccaaatttcgagttcgggatgggatctaagggaaatgtcggaaaccactcgagggaaaccactggacctgcagatgctaataccaagccgatcatcatggagttggcatttggagccatggaggagctcttggtgatggctcaagtggctgaaccactgtggatgggaggatttaatggcactagcttagctttgaacttggatgaatacgaaaagacgtttcgcacgggtctcggtcctagacttggcgggtttcgaaccgaggcatccagggaaactgcactcgtggcaatgtgtcctactggcattgttgaaatgctcatgcaagagaatctgtggtcaacaatgtttgccggaattgttggtagagccaggactcatgaacagataatggctgatgctgctggaaacttcaatggaaatctccaaataatgagtgctgagtaccaagtgctttccccgctagtcacaacccgcgaaagctacttcgtccgctactgtaagcaacaaggagagggtttgtgggcggtggtcgatatttccatcgaccatctcctcccaaacatcaacctaaaatgtcgccgccgaccctctggatgtctgattcaagaaatgcatagtggttactccaaggttacatgggtggaacatgtggaagtagatgatgcaggaagttacagcatctttgagaaattaatctgtactggtcaagcttttgctgctaaccgctgggttggtacattggtacgccagtgtgagcggatatctagcatcttgtcgacagattttcaatctgtcgattccggtgatcacataacgctaactaaccatggaaagatgagcatgctgaagatagctgagcggattgcgagaaccttctttgctggaatgaccaatgcgacggggtctacaatattttctggtgttgaaggagaagatatcagagtgatgacaatgaagagcgtgaatgatccaggaaagcctcccggtgtcattatttgtgcagccacttccttttggcttcctgctcctcctaacactgtctttgacttcctcagagaggctactcaccgacacaattgggatgttctctgcaacggagagatgatgcacaagatagcagagattacgaatgggatagacaaaaggaactgtgcaagtttactccggcatggacacactagcaagagcaagatgatgatagttcaagagacttctactgacccaacagcttcatttgtgctttatgcgcctgttgatatgacatcaatggatattactctccatggaggtggtgatcctgactttgtggtgatcctgccttctggttttgctatttttccagatggtacgggtaagcctggaggaaaagaaggaggatcacttttgaccatttccttccaaatgctggttgagtcaggtcctgaggctaggctgagtgttagctctgttgcaactactgagaatctgattcgtacaaccgtgcggaggatcaaagatttgtttccttgtcagactgcttga

SEQ ID NO: 2656 - protein, 725 aa, Arabidopsis thaliana
  G1544
MSQSNMVPVANNGDNNNDNENNNNNNNNGGTDNTNAGNDSGDQDFDSGNTSSGNHGEGLGNNQAPRHKKKKYNRHTQLQISEMEAFFRECPHPDDKQRYDLSAQLGLDPVQIKFWFQNKRTQNKNQQERFENSELRNLNNHLRSENQRLREAIHQALCPKCGGQTAIGEMTFEEHHLRILNARLTEEIKQLSVTAEKISRLTGIPVRSHPRVSPPNPPPNFEFGMGSKGNVGNHSRETTGPADANTKPIIMELAFGAMEELLVMAQVAEPLWMGGFNGTSLALNLDEYEKTFRTGLGPRLGGFRTEASRETALVAMCPTGIVEMLMQENLWSTMFAGIVGRARTHEQIMADAAGNFNGNLQIMSAEYQVLSPLVTTRESYFVRYCKQQGEGLWAVVDISIDHLLPNINLKCRRRPSGCLIQEMHSGYSKVTWVEHVEVDDAGSYSIFEKLICTGQAFAANRWVGTLVRQCERISSILSTDFQSVDSGDHITLTNHGKMSMLKIAERIARTFFAGMTNATGSTIFSGVEGEDIRVMTMKSVNDPGKPPGVIICAATSFWLPAPPNTVFDFLREATHRHNWDVLCNGEMMHKIAEITNGIDKRNCASLLRHGHTSKSKMMIVQETSTDPTASFVLYAPVDMTSMDITLHGGGDPDFVVILPSGFAIFPDGTGKPGGKEGGSLLTISFQMLVESGPEARLSVSSVATTENLIRTTVRRIKDLFPCQTA

SEQ ID NO: 2657 - DNA, 766 bp, Arabidopsis thaliana
  G1545
catcaccaatcttttgaatctaagagagagaagaagaagaaggtctagagaacgaaaagaagaaacatgaataaccagaatgtagatgatcataatcttctactcatttctcaattgtaccctaatgtctatactccattagtaccacaacaaggaggagaagcaaaaccaacacggcggaggaaaaggaagagcaagagtgttgtggtggcagaggagggtgaaaacgaaggcaatgggtggtttagaaagagaaaattgagtgatgagcaagtaagaatgttggagattagctttgaagacgatcataagcttgaatccgagaggaaagatcggcttgcttctgagttagggcttgatcctcgtcaagtcgccgtctggttccaaaaccgccgtgcacggtggaagaacaaacgagtcgaggatgaatacactaaactcaagaatgcatacgaaaccaccgtcgttgagaaatgtcgtcttgattctgaggttattcacctaaaggaacaactttacgaggctgaaagagagatccaacggcttgcaaaaagagttgaaggaactttaagtaacagtcctatctcatcctctgtgaccattgaagccaatcatacgacaccgttttttggagattacgacatcggatttgacggtgaggctgacgagaacttgctctactcgccagattacattgatggattagactggatgagccaatttatgtaaaaaactataagctaatctattttcagtcgtagtatag

SEQ ID NO: 2658 - protein, 220 aa, Arabidopsis thaliana
  G1545
MNNQNVDDHNLLLISQLYPNVYTPLVPQQGGEAKPTRRRKRKSKSVVVAEEGENEGNGWFRKRKLSDEQVRMLEISFEDDHKLESERKDRLASELGLDPRQVAVWFQNRRARWKNKRVEDEYTKLKNAYETTVVEKCRLDSEVIHLKEQLYEAEREIQRLAKRVEGTLSNSPISSSVTIEANHTTPFFGDYDIGFDGEADENLLYSPDYIDGLDWMSQFM

SEQ ID NO: 2659 - DNA, 1440 bp, Arabidopsis thaliana
  G1560
atcctttcaatttccactcctctctaatataattcacattttcccactattgctgattcatttttttttgtgaattatttcaaacccacataaaaaaatctttgtttaaatttaaaaccatggatccttcatttaggttcattaaagaggagtttcctgctggattcagtgattctccatcaccaccatcttcttcttcatacctttattcatcttccatggctgaagcagccataaatgatccaacaacattgagctatccacaaccattagaaggtctccatgaatcagggccacctccatttttgacaaagacatatgacttggtggaagattcaagaaccaatcatgtcgtgtcttggagcaaatccaataacagcttcattgtctgggatccacaggccttttctgtaactctccttcccagattcttcaagcacaataacttctccagttttgtccgccagctcaacacatatggtttcagaaaggtgaatccggatcggtgggagtttgcaaacgaagggtttcttagagggcaaaagcatctcctcaagaacataaggagaagaaaaacaagtaataatagtaatcaaatgcaacaacctcaaagttctgaacaacaatctctagacaatttttgcatagaagtgggtaggtacggtctagatggagagatggacagcctaaggcgagacaagcaagtgttgatgatggagctagtgagactaagacagcaacaacaaagcaccaaaatgtatctcacattgattgaagagaagctcaagaagaccgagtcaaaacaaaaacaaatgatgagcttccttgcccgcgcaatgcagaatccagattttattcagcagctagtagagcagaaggaaaagaggaaagagatcgaagaggcgatcagcaagaagagacaaagaccgatcgatcaaggaaaaagaaatgtggaagattatggtgatgaaagtggttatgggaatgatgttgcagcctcatcctcagcattgattggtatgagtcaggaatatacatatggaaacatgtctgaattcgagatgtcggagttggacaaacttgctatgcacattcaaggacttggagataattccagtgctagggaagaagtcttgaatgtggaaaaaggaaatgatgaggaagaagtagaagatcaacaacaagggtaccataaggagaacaatgagatttatggtgaaggtttttgggaagatttgttaaatgaaggtcaaaattttgattttgaaggagatcaagaaaatgttgatgtgttaattcagcaacttggttatttgggttctagttcacacactaattaagaagaaattgaaatgatgactactttaagcatttgaatcaacttgtttcctattagtaatttggctttgtttcaatcaagtgagtcgtggactaacttgc

SEQ ID NO: 2660 - protein, 406 aa, Arabidopsis thaliana
  G1560
MDPSFRFIKEEFPAGFSDSPSPPSSSSYLYSSSMAEAAINDPTTLSYPQPLEGLHESGPPPFLTKTYDLVEDSRTNHVVSWSKSNNSFIVWDPQAFSVTLLPRFFKHNNFSSFVRQLNTYGFRKVNPDRWEFANEGFLRGQKHLLKNIRRRKTSNNSNQMQQPQSSEQQSLDNFCIEVGRYGLDGEMDSLRRDKQVLMMELVRLRQQQQSTKMYLTLIEEKLKKTESKQKQMMSFLARAMQNPDFIQQLVEQKEKRKEIEEAISKKRQRPIDQGKRNVEDYGDESGYGNDVAASSSALIGMSQEYTYGNMSEFEMSELDKLAMHIQGLGDNSSAREEVLNVEKGNDEEEVEDQQQGYHKENNEIYGEGFWEDLLNEGQNFDFEGDQENVDVLIQQLGYLGSSSHTN

SEQ ID NO: 2661 - DNA, 1962 bp, Arabidopsis thaliana
  G1574
atggatgatacaatggacatgagttcaggtagtgatgaagaagtacaagaagagaagaccactgttaacgagagggtcatctatcaggctgcattacaagatctgaagcaacccaagaccgaaaaggatctacctcctggtgttcttacagttcctcttatgaggcatcagaaaattgcattgaactggatgcgtaagaaagaaaaaagaagcaggcactgtttgggagggatattagcagatgatcagggacttggtaaaacgatctcgacgatctctcttatcctgttacaaaagttgaagtcacaatcaaagcagagaaagcgaaaaggtcaaaactctggtggtacattgattgtttgtccagcaagtgttgtaaaacaatgggcaagagaagttaaagagaaggtttctgatgaacacaaactctctgttttagtccaccatggatctcacagaaccaaagatccaacagaaatagcaatatatgatgtggtcatgacaacttacgccattgttacaaatgaagttccacaaaaccctatgctgaatcgttatgatagtatgagaggcagagaaagccttgacggatcgagtttgattcagcctcacgttggtgcactaggaagagttaggtggttgagagtagtattagatgaagctcatacaattaaaaaccatagaaccctaattgcaaaagcttgttttagccttagagccaaaaggagatggtgtttgactggaacgccgataaagaacaaagtagacgatctttatagctatttcagatttcttagatatcatccatatgccatgtgcaattcatttcaccaaagaatcaaagctccaattgataaaaagcctcttcatggttacaagaagcttcaagctattctaaggggtataatgttgcgccgcaccaaagaatggtctttctacaggaagcttgaattgaattcacgttggaagtttgaggaatatgctgctgatgggactttgcatgaacacatggcttatcttttggtgatgcttttgcgactacgccaagcttgtaaccatccacaacttgttaacggatatagtcactcagatactacaagaaaaatgtcagatggagttcgagtagcccctagagagaatctaatcatgttcctcgatctcttgaaattatcctcaaccacctgctctgtttgtagtgatccaccaaaagaccctgttgttactttgtgtggccatgtgttttgttatgagtgtgtgtctgtaaacattaacggggataacaatacgtgccctgcacttaattgccacagccagcttaaacatgatgttgttttcactgaatctgcagttagaagttgcatcaacgattatgatgatcctgaagataaaaatgctttagttgcatcaaggcgagtttatttcatcgaaaatccgagctgtgatagagattcttcagtcgcttgcagagcaaggcagtccagacactccaccaataaagacaatagtatcagtggactgaatctcatttttacgtttctcaaagacaaatgtaatgattatgaaacaggtgcgatgttgatgtctcttaaagctggaaaccttggattgaatatggtagctgcaagtcatgtcattctactggacctatggtggaatccaacaacagaggatcaagctattgatcgagctcatcgtatcggacaaactcgagctgttacggtcactcgtattgccatcaaaaataccgttgaggaacgaattttgactcttcatgaacgtaaaaggaacattgttgcatctgcattgggtgaaaaaaactggcaaaagttctgcgattcaactaacactagaagatctcgaatatctgttttttggtgtgtagaatatcccagagtttttattgataagaggaataaaacctttagctatttaataagtcacaagtgtgaatgtaatgaataa

SEQ ID NO: 2662 - protein, 653 aa, Arabidopsis thaliana
  G1574
MDDTMDMSSGSDEEVQEEKTTVNERVIYQAALQDLKQPKTEKDLPPGVLTVPLMRHQKIALNWMRKKEKRSRHCLGGILADDQGLGKTISTISLILLQKLKSQSKQRKRKGQNSGGTLIVCPASVVKQWAREVKEKVSDEHKLSVLVHHGSHRTKDPTEIAIYDVVMTTYAIVTNEVPQNPMLNRYDSMRGRESLDGSSLIQPHVGALGRVRWLRVVLDEAHTIKNHRTLIAKACFSLRAKRRWCLTGTPIKNKVDDLYSYFRFLRYHPYAMCNSFHQRIKAPIDKKPLHGYKKLQAILRGIMLRRTKEWSFYRKLELNSRWKFEEYAADGTLHEHMAYLLVMLLRLRQACNHPQLVNGYSHSDTTRKMSDGVRVAPRENLIMFLDLLKLSSTTCSVCSDPPKDPVVTLCGHVFCYECVSVNINGDNNTCPALNCHSQLKHDVVFTESAVRSCINDYDDPEDKNALVASRRVYFIENPSCDRDSSVACRARQSRHSTNKDNSISGLNLIFTFLKDKCNDYETGAMLMSLKAGNLGLNMVAASHVILLDLWWNPTTEDQAIDRAHRIGQTRAVTVTRIAIKNTVEERILTLHERKRNIVASALGEKNWQKFCDSTNTRRSRISVFWCVEYPRVFIDKRNKTFSYLISHKCECNE

SEQ ID NO: 2663 - DNA, 1502 bp, Arabidopsis thaliana
  G1584
attcacatttttatttatctttccatttagccattctgttccctgtctcttcctcctctctttttgacacatcacatcatcatcacatcatcattcaacatcaatcatcatcatatgcatacacatacatctgtgttctgcggatcgagttaattagttatggcttcttcgaatagacactggccaagcatgttcaagtccaaacctcatccccatcaatggcaacatgacatcaactctcctctcttgccttctgcttctcaccgatcttctcctttctcttcaggatgtgaagtggagaggagtccagagccaaaaccaagatggaatccaaagccagagcagattcggatacttgaagcaatctttaactccgggatggtgaatcctccaagagaggagatcaggcttcaagaatacggccaagtcggtgatgctaacgtcttctactggttccaaaaccgtaagtcccgtagtaaacacaaactccgcctcctccacaaccactccaaacactctctccctcaaacgcaaccgcagccgcagccgcaaccttcggcttcctcttcctcttcctcctcctcttcctcctccaaatccaccaaaccccgaaaaagcaagaacaagaacaacactaatctctctttgggtggtagtcaaatgatggggatgtttccaccggaaccggcgtttctcttcccggtctccactgtcggagggtttgaaggtatcaccgtctcatcccaattagggtttctctccggtgatatgattgagcaacaaaaaccggctccaacgtgtaccggactcctgctgagtgagatcatgaacggtagtgtgagttatggaactcatcatcaacaacacttgagtgagaaagaagttgaagaaatgaggatgaagatgttgcaacagccacagactcagatttgttacgctaccactaatcatcaaatagcttcttacaacaacaacaacaacaacaataacatcatgcttcatattcctcccactacttctactgccaccactattactacttcgcattctctcgctactgtcccatcaacttcggaccagcttcaagttcaagcggacgcacgaataagagttttcatcaatgaaatggagcttgaagtgagctcaggaccgttcaatgtgagggatgcatttggggaagaggttgttctgattaattccgcgggtcagcccattgtcaccgatgaatatggcgtcgctcttcaccctcttcaacacggagcctcgtactatctgatctagtcgtgtgggagatttgagtttgaagaagaaattaagacctgtctctttctttcaccatctctcgtacgtaggcttaaatgttaagattttataaagtattggtttcagttacctgttgtgacggtgtttatgtatgagtttcggacaacattcacaaaactctctcgttaaattgttgaccaataatatatgatgtgtgtttcattattatctaaaaaaaa

SEQ ID NO: 2664 - protein, 373 aa, Arabidopsis thaliana
  G1584
MASSNRHWPSMFKSKPHPHQWQHDINSPLLPSASHRSSPFSSGCEVERSPEPKPRWNPKPEQIRILEAIFNSGMVNPPREEIRLQEYGQVGDANVFYWFQNRKSRSKHKLRLLHNHSKHSLPQTQPQPQPQPSASSSSSSSSSSSKSTKPRKSKNKNNTNLSLGGSQMMGMFPPEPAFLFPVSTVGGFEGITVSSQLGFLSGDMIEQQKPAPTCTGLLLSEIMNGSVSYGTHHQQHLSEKEVEEMRMKMLQQPQTQICYATTNHQIASYNNNNNNNNIMLHIPPTTSTATTITTSHSLATVPSTSDQLQVQADARIRVFINEMELEVSSGPFNVRDAFGEEVVLINSAGQPIVTDEYGVALHPLQHGASYYLI

SEQ ID NO: 2665 - DNA, 807 bp, Arabidopsis thaliana
  G1586
atgaatcaagaaggtgcttcacatagcccatcctccacttccaccgaaccagtccgggcacgttggtcacctaaaccggagcaaatcttgatactcgaatccatcttcaacagtggtactgttaacccaccaaaagatgaaacggtgaggataagaaagatgcttgagaaattcggtgctgtgggagacgcaaacgtcttctactggtttcaaaaccgacggtcaagatctcgccggagacaccggcagcttttagcagccaccaccgcagccgccacctccataggagctgaagaccaccagcacatgacggccatgagcatgcatcaatatccttgcagcaacaacgagattgatttggggtttggaagttgtagcaacttatcagctaattacttccttaatggatcgtcgtcatctcaaatcccttcctttttcctcggcctctcttcttcaagtggtgggtgtgagaacaacaatggtatggagaatctcttcaaaatgtatggccatgaatctgatcataatcatcagcagcagcatcatagctcaaatgctgcatcagttttaaacccatctgatcaaaactccaactcccaatacgaacaagaagggtttatgacggtgtttataaacggagttcctatggaagtaacaaaaggagcaatagacatgaaaacaatgttcggtgatgattcggtgttacttcattcctctggtcttcctcttcccactgatgagtttggtttcttgatgcattctttacaacatggacaaacttatttcctggtaccgagacagacatga

SEQ ID NO: 2666 - protein, 268 aa, Arabidopsis thaliana
  G1586
MNQEGASHSPSSTSTEPVRARWSPKPEQILILESIFNSGTVNPPKDETVRIRKMLEKFGAVGDANVFYWFQNRRSRSRRRHRQLLAATTAAATSIGAEDHQHMTAMSMHQYPCSNNEIDLGFGSCSNLSANYFLNGSSSSQIPSFFLGLSSSSGGCENNNGMENLFKMYGHESDHNHQQQHHSSNAASVLNPSDQNSNSQYEQEGFMTVFINGVPMEVTKGAIDMKTMFGDDSVLLHSSGLPLPTDEFGFLMHSLQHGQTYFLVPRQT

SEQ ID NO: 2667 - DNA, 816 bp, Arabidopsis thaliana
  G1587
atgggctacatctccaacaacaacctcatcaactatttgcccctctctactactcaacctcctcttcttctcacccactgtgatattaacggcaatgatcaccatcagctcataaccgcatcatcaggagaacacgatattgatgaacggaaaaacaacattcctgcggcggcgactttgagatggaatccgacgccagagcagatcacgacgctagaagagctttacagaagcggaacacggacgccgacgacggaacagatccaacagatagcatctaagcttcgtaaatatgggagaatcgaagggaagaacgttttctattggtttcagaatcataaggctagagagagactaaaacgccgccgtcgtgaaggtggtgctattatcaaaccacataaagacgtcaaggattcatcatcaggtggtcatcgagttgatcagacaaagctctgcccatcttttccacacacaaaccgaccacagccacagcatgaattagatcctgcgagttacaataaagacaacaatgctaataatgaagatcatgggacgactgaagaatctgatcagagggcatcagaggttggtaaatacgccacatggagaaatcttgttacttggtcgataactcaacaaccggaagagattaatatcgacgaaaatgtcaacggagaagaagaagaaacgagggacaaccggactttaaatctctttccggttagggagtaccaagagaaaacaggccggttgatagagaagacgaaagcatgcaactactgttactactacgagttcatgcctctgaagaactga

SEQ ID NO: 2668 - protein, 271 aa, Arabidopsis thaliana
  G1587
MGYISNNNLINYLPLSTTQPPLLLTHCDINGNDHHQLITASSGEHDIDERKNNIPAAATLRWNPTPEQITTLEELYRSGTRTPTTEQIQQIASKLRKYGRIEGKNVFYWFQNHKARERLKRRRREGGAIIKPHKDVKDSSSGGHRVDQTKLCPSFPHTNRPQPQHELDPASYNKDNNANNEDHGTTEESDQRASEVGKYATWRNLVTWSITQQPEEINIDENVNGEEEETRDNRTLNLFPVREYQEKTGRLIEKTKACNYCYYYEFMPLKN

SEQ ID NO: 2669 - DNA, 2232 bp, Arabidopsis thaliana
  G1588
atgtaccatccaaacatgtttgagagccatcatatgttcgatatgaccccaaagagtacctctgataacgacttgggaatcaccggtagccgagaagatgactttgagaccaagtcaggtaccgaagtcactactgagaatccttctggtgaagagcttcaagatcctagccaacgtcccaacaaaaagaagcgttaccatcgccacacgcaacgccaaattcaagagctcgaatcattctttaaggaatgtcctcatccagatgataagcaacgaaaagagttgagccgtgatctcaatttagagcctcttcaagttaagttttggttccaaaacaaacgcacacagatgaaggcacaaagtgagaggcatgagaaccagattctaaagtcagacaatgacaagctcagagcagagaacaatagatacaaagaagctctaagcaatgctacatgccctaactgtggcggtccagctgctattggagaaatgtcttttgacgaacaacatctcaggatcgaaaatgctcggctccgcgaagagattgataggatctctgctattgctgcgaaatacgttgggaagccgttaggatcgtctttcgctccactagcgatccacgcgccttctcgttcgcttgatcttgaagttggaaactttgggaaccagacaggctttgtaggagaaatgtatggaacaggggacattttgaggtcagtttcgattccttctgagactgataagcctataatcgtggagctagcggttgcagctatggaggaactcgtgagaatggctcaaactggagatcctttatggctttcaaccgataattcagtcgagattctcaacgaagaagagtatttcagaacgtttccgagaggaattggaccaaagccattaggattaagatcagaggcgtcaagacaatctgcagttgttataatgaatcacatcaatctcgttgagattctcatggatgtgaatcaatggtcttgtgttttctctgggattgtgtcaagagccttgacacttgaagttctttcaactggagttgctgggaactacaacggtgctttacaagtgatgacagctgagtttcaagttccatcacccctagtcccaacgcgtgagaactactttgtgagatactgcaaacaacacagtgacggctcttgggctgtggttgatgtctctttggacagccttagaccaagtactccaatcttaagaactagaagaaggccttcaggttgtctgattcaagaattgcctaatggttattctaaggttacatggatagagcatatggaggtagatgatagatcagttcacaacatgtataaaccgttggttcagtccggtttagctttcggtgcgaaacgttgggtggctacactcgaacgacaatgcgagcggcttgctagctccatggccagcaacattcctggtgatctttccgtgataacgagtcctgaaggaaggaagagtatgttgaagctagctgagagaatggttatgagtttctgcagtggtgttggcgcgtcgactgcacacgcttggacaacaatgtcgacaacaggatccgatgatgttcgggtcatgacccgcaagagtatggatgatccaggaagacctccgggtattgttcttagtgcagctacttcattctggatcccagttgctcccaaacgtgtttttgatttcctccgtgacgaaaattcaagaaaagagtgggatattctgtcaaatggaggtatggttcaggaaatggctcatatagccaatggtcatgaacctggaaactgtgtctccttgctccgagtcaatagtggaaactcgagccagagcaacatgttgattctacaagagagctgtacagatgcatcaggatcgtatgtgatttacgcgccagtggatatagtggcgatgaatgtggttctaagcggtggagatcctgattacgtggcgttgttgccgtctggttttgctattttaccggatggttcggttggaggaggagatgggaatcagcatcaggaaatggtttctactacttcttctgggagttgtggtggttcgcttttaaccgttgcgtttcagattcttgttgactctgttcctacagctaaactctcacttggctcggtggctacggttaatagtctgatcaaatgtacggtggagaggattaaagctgctgtttcttgtgatgttggaggaggagcgtag

SEQ ID NO: 2670 - protein, 743 aa, Arabidopsis thaliana
  G1588
MYHPNMFESHHMFDMTPKSTSDNDLGITGSREDDFETKSGTEVTTENPSGEELQDPSQRPNKKKRYHRHTQRQIQELESFFKECPHPDDKQRKELSRDLNLEPLQVKFWFQNKRTQMKAQSERHENQILKSDNDKLRAENNRYKEALSNATCPNCGGPAAIGEMSFDEQHLRIENARLREEIDRISAIAAKYVGKPLGSSFAPLAIHAPSRSLDLEVGNFGNQTGFVGEMYGTGDILRSVSIPSETDKPIIVELAVAAMEELVRMAQTGDPLWLSTDNSVEILNEEEYFRTFPRGIGPKPLGLRSEASRQSAVVIMNHINLVEILMDVNQWSCVFSGIVSRALTLEVLSTGVAGNYNGALQVMTAEFQVPSPLVPTRENYFVRYCKQHSDGSWAVVDVSLDSLRPSTPILRTRRRPSGCLIQELPNGYSKVTWIEHMEVDDRSVHNMYKPLVQSGLAFGAKRWVATLERQCERLASSMASNIPGDLSVITSPEGRKSMLKLAERMVMSFCSGVGASTAHAWTTMSTTGSDDVRVMTRKSMDDPGRPPGIVLSAATSFWIPVAPKRVFDFLRDENSRKEWDILSNGGMVQEMAHIANGHEPGNCVSLLRVNSGNSSQSNMLILQESCTDASGSYVIYAPVDIVAMNVVLSGGDPDYVALLPSGFAILPDGSVGGGDGNQHQEMVSTTSSGSCGGSLLTVAFQILVDSVPTAKLSLGSVATVNSLIKCTVERIKAAVSCDVGGGA

SEQ ID NO: 2671 - DNA, 2385 bp, Arabidopsis thaliana
  G1589
accaaactcacatagcaatcacacacatctccacaaacacagcttgagatgatcatgaaacacgtgcatcctcagatctctatcaatccagcttggtgaaagaaggtcaagaattgaaagagaatcaaagaaaacgacgtcgtttcattcgtgtgtaacaactactaattatacatagatggctgcttactttcacggaaacccaccggagatctctgccggatccgacggtggtcttcaaacgttgatcctcatgaatccaactacttacgttcagtacacccaacaagacaacgactcgaacaacaacaacaacagcaacaatagcaacaacaacaacacaaacacaaacacaaacaacaacaacagtagtttcgttttcctcgattcccacgcgccgcagccaaacgcgagccagcagttcgtcggaataccactctcaggtcacgaagctgcttccattacagccgccgacaacatctccgtacttcacggttatcctccgcgcgtgcagtacagtctctacggtagccaccaagtggatcccactcaccagcaagccgcgtgtgagacgccacgcgcgcagcaaggcctctctttaaccctctcgtctcaacagcagcagcaacagcaacatcatcaacaacaccagcctattcacgtcggattcgggtccggacatggagaagatatccgggtcgggtctggctctacaggatcgggggtaacaaacggtatagctaatcttgttagctccaagtacttgaaggcagcacaagagcttcttgacgaagtagtcaacgctgattccgatgacatgaacgctaaatcccaactattctcatcgaaaaagggtagttgcggaaatgataaacctgtcggagaatcatcggccggcgctggaggagaaggttccggtggcggagcagaagcagccgggaaacgtccggtggagctaggcacggcagagagacaagaaatacagatgaagaaagcaaaacttagtaacatgcttcatgaggtggagcagagatatagacagtaccaccagcagatgcagatggtgatctcttcgttcgagcaagcggcagggataggatcagcgaagtcatacacgtcgctagcattgaaaaccatatcaagacagttccgttgcttgaaagaggcgatcgctggtcagataaaagcggccaacaagagtcttggggaggaagattcagtgtctggtgttgggaggtttgaggggtcgaggctcaagttcgtggaccaccacttgagacagcaaagagctcttcaacaactgggaatgattcaacatccttccaataatgcttggagacctcaacgtggtctcccagaacgagccgtctcagttctccgtgcttggctcttcgaacactttcttcatccataccctaaggattcggacaagcacatgctagctaagcaaacaggactcactcgtagccaggtgtcgaactggtttataaacgcgagagttcggttatggaaaccaatggtggaggagatgtacatggaggaaatgaaggagcaggcaaagaacatgggatccatggaaaagactcctttggatcaaagcaacgaagattctgcttcaaagtcaacaagtaaccaagaaaagagcccaatggcggacactaattaccatatgaatcccaatcacaacggtgacctagaaggcgtcactggaatgcaaggatgccccaagagactaagaaccagcgacgagacaatgatgcagccaataaatgcggatttcagctccaacgagaagctcacgatgaagattctagaagaacggcaagggataagatcagatggtggctaccctttcatgggtaatttcgggcaataccaaatggatgagatgtcaagatttgatgtagtctcagaccaggagctcatggcgcaaaggtactcaggaaacaacaatggcgtgtccctcacgttaggtttacctcattgtgatagcttgtcgtccacggaccatcagggtttcatgcagacccaccatgggattcctatagggagaagagtgaaaataggagaaacagaggaatatggacccgccaccatcaatggtggtagctcgaccacaaccgcacattcatcagcggcagctgccgcggcttacaatgggatgaacatacagaaccagaagagatatgtggctcagttattgcccgacttcgttgcataaacccatctctctagaaggagaaaccgaaacaggttattatatacgtttctagtttttaattagtatatagtttctcataccattgaaccaaaacaaagaacaaaatttaattttagtctttggttatatatggccgacgggctacgtcagggccctgacgtagc

SEQ ID NO: 2672 - protein, 680 aa, Arabidopsis thaliana
  G1589
MAAYFHGNPPEISAGSDGGLQTLILMNPTTYVQYTQQDNDSNNNNNSNNSNNNNTNTNTNNNNSSFVFLDSHAPQPNASQQFVGIPLSGHEAASITAADNISVLHGYPPRVQYSLYGSHQVDPTHQQAACETPRAQQGLSLTLSSQQQQQQQHHQQHQPIHVGFGSGHGEDIRVGSGSTGSGVTNGIANLVSSKYLKAAQELLDEVVNADSDDMNAKSQLFSSKKGSCGNDKPVGESSAGAGGEGSGGGAEAAGKRPVELGTAERQEIQMKKAKLSNMLHEVEQRYRQYHQQMQMVISSFEQAAGIGSAKSYTSLALKTISRQFRCLKEAIAGQIKAANKSLGEEDSVSGVGRFEGSRLKFVDHHLRQQRALQQLGMIQHPSNNAWRPQRGLPERAVSVLRAWLFEHFLHPYPKDSDKHMLAKQTGLTRSQVSNWFINARVRLWKPMVEEMYMEEMKEQAKNMGSMEKTPLDQSNEDSASKSTSNQEKSPMADTNYHMNPNHNGDLEGVTGMQGCPKRLRTSDETMMQPINADFSSNEKLTMKILEERQGIRSDGGYPFMGNFGQYQMDEMSRFDVVSDQELMAQRYSGNNNGVSLTLGLPHCDSLSSTDHQGFMQTHHGIPIGRRVKIGETEEYGPATINGGSSTTTAHSSAAAAAAYNGMNIQNQKRYVAQLLPDFVA

SEQ ID NO: 2673 - DNA, 984 bp, Arabidopsis thaliana
  G1594
atggatggaatgtacaatttccattcggccggtgattattcagataagtcggttctgatgatgtcaccggagagtctcatgtttccttccgattaccaagctttgctatgttcctccgccggtgaaaatcgtgtctctgatgttttcggatccgacgagctactctcagtagccgtctccgctttgtcgtcggaggcggcttcgatcgctccggagatccgaagaaatgatgataacgtttctctaactgtcatcaaagctaaaatcgcttgtcatccttcgtatcctcgcttacttcaagcttacatcgattgccaaaaggtcggagcaccaccggagatagcgtgtttactagaggagattcaacgggagagtgatgtttataagcaagaggttgttccttcttcttgctttggagctgatcctgagcttgatgaatttatggaaacgtactgcgatatattagtgaaatacaaatcggatctagcaagaccgtttgacgaggcaacgtgtttcttgaacaagattgagatgcagctacggaacctatgtactggtgtcgagtctgccaggggagtttctgaggatggtgtaatatcatctgacgaggaactgagtggaggtgatcatgaggtagcagaggatgggagacaaagatgtgaagaccgggacctcaaagataggttgctacgcaaatttggaagccgtattagtactttaaagcttgagttctcaaagaagaagaagaaaggaaagttaccaagagaagcaagacaagctcttcttgattggtggaatctccattataagtggccttaccctactgaaggagataagatagcattagctgatgcaacggggttagaccaaaaacaaatcaacaattggtttataaaccaaaggaaacgtcattggaagccatcagagaatatgcctttcgctatgatggatgattctagtggatcattctttaccgaggaatga

SEQ ID NO: 2674 - protein, 327 aa, Arabidopsis thaliana
  G1594
MDGMYNFHSAGDYSDKSVLMMSPESLMFPSDYQALLCSSAGENRVSDVFGSDELLSVAVSALSSEAASIAPEIRRNDDNVSLTVIKAKIACHPSYPRLLQAYIDCQKVGAPPEIACLLEEIQRESDVYKQEVVPSSCFGADPELDEFMETYCDILVKYKSDLARPFDEATCFLNKIEMQLRNLCTGVESARGVSEDGVISSDEELSGGDHEVAEDGRQRCEDRDLKDRLLRKFGSRISTLKLEFSKKKKKGKLPREARQALLDWWNLHYKWPYPTEGDKIALADATGLDQKQINNWFINQRKRHWKPSENMPFAMMDDSSGSFFTEE

SEQ ID NO: 2675 - DNA, 1164 bp, Arabidopsis thaliana
  G1635
atggcgtcgtctccgttgactgcaaatgttcagggtaccaacgcttctttgaggaatagagatgaagaaactgcagacaagcagatacaattcaatgaccaaagttttgggggaaatgactatgcacccaaggtacggaagccatacacgataacaaaagagagagagagatggacagatgaagagcacaagaagtttgttgaagccttgaaattatacgggcgagcttggagacgaatagaagaacatgtgggctcaaagaccgcagttcagattcgaagccatgctcagaagtttttctctaaggttgctcgagaagcaactggaggtgatgggagctcagtagagccgattgtaatacctcctcctcgtcccaagagaaagccagcgcatccgtaccctcgtaagtttgggaacgaggcagatcaaacaagtagatcggtttctccctcagaacgtgatactcaatctccaacctctgtgttgtccactgttggatcagaagcattgtgttcccttgattcgagttcacccaatcgaagcttgtccccagtttcttctgcatcaccaccagctgctcttacaaccactgcaaatgcacctgaagagcttgagactctgaagctggagttgtttcctagtgagagactcttaaacagggagagctcgatcaaggaaccaacgaagcaaagtcttaaactctttgggaagacagttttggtatctgattcaggcatgtcctcttctctaacaacttcaacatattgtaaatccccaattcagccattaccacggaaactctcatcatccaagacactacccataataagaaactcacaagaagaactcttgagctgctggatacaagtccctcttaagcaagaagatgtggaaaatagatgtttggattcaggaaaggctgtccaaaacgaaggatcatcgactggatcaaacactggttcggtggatgatacgggacacacggaaaagaccacagaacccgaaacaatgctatgtcaatgggagtttaaaccaagtgagaggtctgcattttctgagctcagaagaacaaactccgagtcaaattcaagaggatttggtccatacaagaagagaaagatggtaacagaagaagaagagcatgagattcatctccacttataa

SEQ ID NO: 2676 - protein, 387 aa, Arabidopsis thaliana
  G1635
MASSPLTANVQGTNASLRNRDEETADKQIQFNDQSFGGNDYAPKVRKPYTITKERERWTDEEHKKFVEALKLYGRAWRRIEEHVGSKTAVQIRSHAQKFFSKVAREATGGDGSSVEPIVIPPPRPKRKPAHPYPRKFGNEADQTSRSVSPSERDTQSPTSVLSTVGSEALCSLDSSSPNRSLSPVSSASPPAALTTTANAPEELETLKLELFPSERLLNRESSIKEPTKQSLKLFGKTVLVSDSGMSSSLTTSTYCKSPIQPLPRKLSSSKTLPIIRNSQEELLSCWIQVPLKQEDVENRCLDSGKAVQNEGSSTGSNTGSVDDTGHTEKTTEPETMLCQWEFKPSERSAFSELRRTNSESNSRGFGPYKKRKMVTEEEEHEIHLHL

SEQ ID NO: 2677 - DNA, 668 bp, Arabidopsis thaliana
  G1636
gagtaatcatcaacgattatggcgtcaagtcagtggacgaggtcggaggataagatgtttgagcaagctttggttctttttcctgaaggatctcctaatcggtgggagagaatcgctgatcagcttcataaatctgctggtgaagttagggagcattacgaggtcttggttcatgatgttttcgagattgattctggtcgagttgatgtccctgattacatggatgactcggcggctgcggcggcgggttgggattccgctggtcagatctcttttgggtctaaacatggcgagagtgaacgcaaaagaggaactccttggacagagaacgaacacaaattgtttctgatcggattaaagagatatggtaagggagattggaggagtatctcgagaaacgttgtggtgacgaggacaccgacgcaagtcgcgagtcacgctcagaagtattttctgagacagaactcggtgaagaaggagaggaaaaggtcgagcatccatgatataactacggttgatgctactttggctatgcctgggtctaacatggactggactggccaacacgggagtcctgttcaggcgccgcagcagcaacagattatgtctgagttcggtcagcaattgaatcctggtcatttcgaggattttgggtttcggatgtgatg

SEQ ID NO: 2678 - protein, 215 aa, Arabidopsis thaliana
  G1636
MASSQWTRSEDKMFEQALVLFPEGSPNRWERIADQLHKSAGEVREHYEVLVHDVFEIDSGRVDVPDYMDDSAAAAAGWDSAGQISFGSKHGESERKRGTPWTENEHKLFLIGLKRYGKGDWRSISRNVVVTRTPTQVASHAQKYFLRQNSVKKERKRSSIHDITTVDATLAMPGSNMDWTGQHGSPVQAPQQQQIMSEFGQQLNPGHFEDFGFRM

SEQ ID NO: 2679 - DNA, 867 bp, Arabidopsis thaliana
  G1641
atggaggttatgagaccgtcgacgtcacacgtgtcaggtgggaactggctcatggaggaaactaagagcggcgtcgcagcttctggtgaaggtgccacgtggacggcggcagagaacaaggcattcgagaatgctttggcggtttacgacgacaacactcctgatcggtggcagaaggtggctgcggtgattccggggaagacagtgagtgacgtaattagacagtataacgatttggaagctgatgtcagcagcatcgaggccggtttaatcccggtccccggttacatcacctcgccgcctttcactctagattgggccggcggcggtggcggatgtaacgggtttaaaccgggtcatcaggtttgtaataaacggtcgcaggccggtagatcgccggagctggagcggaagaaaggcgttccttggacggaggaagaacacaagctatttctaatgggtttgaagaaatatgggaaaggagattggagaaacatatctcggaactttgtgataacgcgaacgccaacacaagtagctagccacgcccaaaagtacttcatccggcaactttccggcggcaaggacaagagacgagcaagcattcacgacataaccaccgtaaatctcgaagaggaggcttctttggagaccaataagagctccattgttgttggagatcagcgttcaaggctaaccgcgtttccttggaaccaaacggacaacaatggaacacaggcagacgctttcaatataacgattggaaacgctattagtggcgttcattcatacggccaggttatgattggagggtataacaatgcagattcttgctatgacgcccaaaacacaatgtttcaactatag

SEQ ID NO: 2680 - protein, 288 aa, Arabidopsis thaliana
  G1641
MEVMRPSTSHVSGGNWLMEETKSGVAASGEGATWTAAENKAFENALAVYDDNTPDRWQKVAAVIPGKTVSDVIRQYNDLEADVSSIEAGLIPVPGYITSPPFTLDWAGGGGGCNGFKPGHQVCNKRSQAGRSPELERKKGVPWTEEEHKLFLMGLKKYGKGDWRNISRNFVITRTPTQVASHAQKYFIRQLSGGKDKRRASIHDITTVNLEEEASLETNKSSIVVGDQRSRLTAFPWNQTDNNGTQADAFNITIGNAISGVHSYGQVMIGGYNNADSCYDAQNTMFQL

SEQ ID NO: 2681 - DNA, 1077 bp, Arabidopsis thaliana
  G1642
atgggtcatcactcatgctgcaacaagcaaaaggtgaagagagggctttggtcacctgaagaagacgaaaagctcatcaactacatcaattcatatggccatggatgttggagctctgttcctaaacatgcaggtttgcagagatgtggaaagagttgtagattaagatggataaattatctaagacctgatcttaaacgtggaagcttctctcctcaagaagctgctcttatcattgagcttcacagcattcttggtaacagatgggctcaaattgctaaacatctacctggaagaacagataacgaggtcaagaatttctggaactcgagcattaaaaagaagctcatgtctcaccatcatcacggtcatcatcatcatcatctctcttccatggcgagtttgctcacaaaccttccttatcacaatggattcaaccctactacagtcgacgatgaaagttcaagattcatgtccaatatcatcacaaacactaaccctaatttcatcactccaagccatctctctcttccttctcctcatgttatgaccccattgatgttcccaacctctagagaaggagatttcaagtttctaaccacaaacaacccaaaccaatctcatcaccatgataataaccattacaacaacctcgacattttgtcacccacaccaactataaacaatcatcatcaaccttcactttcttcttgtcctcatgataataatctccaatggccagcgttaccagatttcccagcgagtaccatttctggtttccaagaaacccttcaagattatgatgatgctaataaactcaacgtgtttgtgacaccattcaacgataatgccaaaaagttattatgtggagaagttctcgaaggcaaagtactatcttcctcctcaccaatttcacaagatcacggcctttttcttcccaccacgtacaactttcaaatgacttctacgagtgatcatcaacatcatcatcgagtggactcatacatcaatcacatgatcataccatcatcatcctcatcgtcgccaatctcttgtggacagtacgtcataacttaa

SEQ ID NO: 2682 - protein, 358 aa, Arabidopsis thaliana
  G1642
MGHHSCCNKQKVKRGLWSPEEDEKLINYINSYGHGCWSSVPKHAGLQRCGKSCRLRWINYLRPDLKRGSFSPQEAALIIELHSILGNRWAQIAKHLPGRTDNEVKNFWNSSIKKKLMSHHHHGHHHHHLSSMASLLTNLPYHNGFNPTTVDDESSRFMSNIITNTNPNFITPSHLSLPSPHVMTPLMFPTSREGDFKFLTTNNPNQSHHHDNNHYNNLDILSPTPTINNHHQPSLSSCPHDNNLQWPALPDFPASTISGFQETLQDYDDANKLNVFVTPFNDNAKKLLCGEVLEGKVLSSSSPISQDHGLFLPTTYNFQMTSTSDHQHHHRVDSYINHMIIPSSSSSSPISCGQYVIT

SEQ ID NO: 2683 - DNA, 348 bp, Arabidopsis thaliana
  G1644
atgaaattgattgattggaaagactgtgctttgatgacttacaccgaactcattttgggtttctgcaatgttttaatgttgatctgcaggaggactagtggacctatgagacgagcaaaaggtggttggactccagaggaggatgagacacttagacgagcagttgaaaagtataaggggaagaggtggaagaaaatagcggaatttttcccagagagaacacaagtccaatgcttgcacaggtggcagaaagttcttaatccagagcttgttaaaggaccttggactcaagaggttctcttatcattttcatgttctgaaactttttttggttttcattttacgtaa

SEQ ID NO: 2684 - protein, 115 aa, Arabidopsis thaliana
  G1644
MKLIDWKDCALMTYTELILGFCNVLMLICRRTSGPMRRAKGGWTPEEDETLRRAVEKYKGKRWKKIAEFFPERTQVQCLHRWQKVLNPELVKGPWTQEVLLSFSCSETFFGFHFT

SEQ ID NO: 2685 - DNA, 1471 bp, Arabidopsis thaliana
  G1649
attcacaaaaaccggaaaaaaaaaaagacaagtaaagaaagctttgttcagtttacttcaatggaagcaaaacccttagcatcatcatcatctgaaccaaacatgatttctccatcatcaaacattaaaccaaaattaaaagatgaagattatatggagctggtgtgtgaaaatgggcagattcttgcaaagattcgaagaccaaagaacaacggttcttttcaaaagcaacgtaggcaatctctcctggatttgtatgagaccgagtacagcgagggtttcaagaaaaacatcaagattcttggagacacacaagttgttccggtgagtcagtctaagccacaacaagataaagaaaccaatgaacaaatgaacaacaataagaagaagctaaagtcctccaaaatcgaatttgagagaaatgtttcgaaaagcaacaaatgtgttgaatcatcaacattaattgatgtttctgctaaaggtccaaagaatgttgaagttactacagctcctcctgatgagcaatctgcagctgttggtagatccacggaattgtattttgcttcttcatcgaagttttctcgaggaacttcgagagatctaagttgttgttctttaaagaggaagtatggagatattgaagaagaagaatcaacctatttaagtaataattcagatgatgaatcagatgatgcgaagacacaagttcatgcgagaacaagaaagccggtgactaaaagaaaacgaagcacagaagtccataagttatatgaaagaaaacgaagagatgaattcaacaagaaaatgcgtgctttgcaggacctactaccaaattgttacaaggatgataaggcttcattgttggatgaggctatcaaatatatgcggacccttcaacttcaagttcagatgatgagtatgggaaatggattaataagaccacctacgatgttgccaatgggtcattactctcccatgggtctaggaatgcatatgggtgcagcagcaacaccaacatcaataccgcaattcctgcctatgaatgttcaagcaaccggttttccggggatgaacaatgcaccaccacaaatgctaagctttcttaatcacccaagtggactaattccaaacactcctatcttttctccattggaaaattgctctcagccattcgtggtgccttcgtgtgtttctcagactcaggctacttcttttactcaattcccaaagtctgcgtccgcctcaaacttagaagatgcaatgcaatatagaggaagcaacggttttagttattatcgctcgccaaactaatgatttgtagaaagttgatgttttctccaactaactaactttaagcaaaaaaaaatgatcgtctactctgtgttgttagtctatgggcttttgggccttgattcttggaacgatttgaacttaattccaactattttcaaagtggatgtacaaagtaaaa

SEQ ID NO: 2686 - protein, 416 aa, Arabidopsis thaliana
  G1649
MEAKPLASSSSEPNMISPSSNIKPKLKDEDYMELVCENGQILAKIRRPKNNGSFQKQRRQSLLDLYETEYSEGFKKNIKILGDTQVVPVSQSKPQQDKETNEQMNNNKKKLKSSKIEFERNVSKSNKCVESSTLIDVSAKGPKNVEVTTAPPDEQSAAVGRSTELYFASSSKFSRGTSRDLSCCSLKRKYGDIEEEESTYLSNNSDDESDDAKTQVHARTRKPVTKRKRSTEVHKLYERKRRDEFNKKMRALQDLLPNCYKDDKASLLDEAIKYMRTLQLQVQMMSMGNGLIRPPTMLPMGHYSPMGLGMHMGAAATPTSIPQFLPMNVQATGFPGMNNAPPQMLSFLNHPSGLIPNTPIFSPLENCSQPFVVPSCVSQTQATSFTQFPKSASASNLEDAMQYRGSNGFSYYRSPN

SEQ ID NO: 2687 - DNA, 871 bp, Arabidopsis thaliana
  G1655
tttctaactagtcacattgagagagagagagagagaaagagagactctcagaatctgaagaagaagaagagattgttgtttttgccttttatcatcggtttctttgaatctctggttttaaatcggatttaatggtggagtctctgttcccgagcatcgaaaacacaggtgaatcgtctcgaagaaagaagccgaggatatcagagacggcggaggcggagatagaggcacgacgtgtcaacgaagaaagcttgaagagatggaaaacgaatcgtgtgcaacagatctacgcttgtaagctcgtcgaagctttacgccgagttcgtcagagatcttccaccaccagcaacaacgagaccgataaactcgtctccggcgcggcgagggagatacgtgatacggcggatcgagttctagctgcgtccgctcgtggtacgactcggtggagcagagcgattttagcgagtcgcgtccgagcgaagctgaagaaacatagaaaggcgaaaaagtcaacgggaaattgtaaatcgagaaaaggtctcacggagacgaatcggattaagttaccggcggttgagagaaaactgaagattcttggccgtttggttcctggttgccggaaagtctctgtaccgaatcttttagatgaagcgaccgattacatcgcagcgttagagatgcaggttcgagccatggaggctctcgccgaacttttaaccgcagccgcaccacggacgacgttgaccggaacttaacggcggcagttagtttgtcagttgttaattagcttttcttttacctttttacccctttattttggcttcaagtgttttttttttctcgtcgacgcgattttaatttattaaattca

SEQ ID NO: 2688 - protein, 207 aa, Arabidopsis thaliana
  G1655
MVESLFPSIENTGESSRRKKPRISETAEAEIEARRVNEESLKRWKTNRVQQIYACKLVEALRRVRQRSSTTSNNETDKLVSGAAREIRDTADRVLAASARGTTRWSRAILASRVRAKLKKHRKAKKSTGNCKSRKGLTETNRIKLPAVERKLKILGRLVPGCRKVSVPNLLDEATDYIAALEMQVRAMEALAELLTAAAPRTTLTGT

SEQ ID NO: 2689 - DNA, 704 bp, Arabidopsis thaliana
  G1663
ttctctctgtgaatccttgttcatcgtcactgaaattagtttacaaaatcgacgaattcggagatgatttttcagaatgtgtgcagaaatgagtccaacttcaacgctatagcttccgaatcgcgttcccaaacgcagttcggtgtttcgaaatcctcctcgagcggcggcggatgtatctccgccaggactaaagaccgtcacacgaaggttaacggacgaagccgtcgagttacgatgccggctctcgccgccgctaggattttccagttaacgcgtgagctcggtcacaaaactgaaggagaaaccatcgaatggcttcttagtcaagctgaaccgtcgattattgccgccactggctacgggactaagctcatttcgaattgggttgatgttgcggcggacgattcctcgtcgtcgtcgtcgatgacgtcgccgcaaacgcaaacgcaaacgccacaatcgccgagttgtaggttggatctttgtcagccaatcggaattcagtatccggtgaatggttacagtcatatgccgttcacagcgatgcttttagagccgatgaccacgacggcggaatctgaggttgagatcgcggaggaggaggaacgtagacgccgtcaccattagtaaaattaggcttttgatttagagtgttaaaattaggattttaaaagtttaggaggtaacagataaggataatt

SEQ ID NO: 2690 - protein, 188 aa, Arabidopsis thaliana
  G1663
MIFQNVCRNESNFNAIASESRSQTQFGVSKSSSSGGGCISARTKDRHTKVNGRSRRVTMPALAAARIFQLTRELGHKTEGETIEWLLSQAEPSIIAATGYGTKLISNWVDVAADDSSSSSSMTSPQTQTQTPQSPSCRLDLCQPIGIQYPVNGYSHMPFTAMLLEPMTTTAESEVEIAEEEERRRRHH

SEQ ID NO: 2691 - DNA, 1891 bp, Arabidopsis thaliana
  G1666
catcatgagcgtatgagagtaaattcttctcacatattaataacaacccttcaaagttataagatttttagagagagagctaccacgttttcgtatctccgggaacgatggatgaatcaagtattattccggcagagaaagtggccggagctgagaaaaaagagcttcaagggctgcttaagacggcggttcaatctgtggactggacttatagtgtcttctggcaattttgtcctcaacaacgggtcttggtgtgggggaatggatactacaacggtgcaataaagacgaggaagacaactcaaccagcggaggtgacggcagaagaggcggcgttagagaggagccaacagctcagggagctttatgagacacttttagccggagagtcaacgtcagaagcaagagcatgcaccgcattgtcaccggaggatttgacggagacagaatggttttatctaatgtgcgtctctttctcttttcctcctccatctgggatgccaggaaaagcgtatgcaaggaggaagcacgtatggctaagtggtgcaaatgaagttgacagtaaaactttttctagagctattctcgctaagagtgctaaaattcagacagtggtttgcattccaatgcttgatggtgttgtggaactaggcacaacgaaaaaggtaagagaagatgtagagtttgttgagctcacaaagagtttcttctatgaccactgcaagacgaacccaaagccggctctttctgaacactccacctacgaagtgcatgaagaagccgaagacgaagaagaagtagaagaagagatgacaatgtcagaggaaatgaggcttggctctcctgatgatgaagatgtttccaatcaaaatctacactctgatcttcatattgaatcaacccatacgttagacacacatatggacatgatgaatctaatggaggaaggtggaaactattctcagacagtaacaacacttctcatgtcacaccccacaagtcttctttcagattcagtttccacatcttcttacatccaatcatcgtttgccacgtggagggttgagaatggcaaagagcatcagcaagtgaaaacggcgccgtcgtcacaatgggtgctcaaacaaatgatcttcagagttcctttcctccatgacaacactaaagataagaggctaccgcgggaagatctgagccacgtagtagcagagcgacgcaggagggagaagctgaacgagaaattcataacgttgagatcaatggttccatttgtgaccaagatggataaagtctcaatccttggagacaccattgcgtacgtaaatcatcttcgaaagagggtccatgagcttgagaatactcatcatgagcaacagcataagcggacgcgtacttgtaagagaaaaacatcggaggaggtggaggtttccatcatagagaatgatgttttgttagagatgagatgtgagtaccgagatggtttgttgcttgacattcttcaggttcttcatgagcttggtatagagactacggcagttcatacctcggtgaacgaccatgatttcgaggcggagataagggcgaaagtaagagggaagaaagcaagcatcgctgaggtcaaaagagccatccaccaagtcataatacatgatactaatctatagaccctaactttattgatgccaactctagagaaggataattaagcgtatttttgttttagcctcacatgtattaagacatcagttacatatatagccggatgcaacatataaatgaaaatgtactagatgatattgttcatttgtccaatgtagtacttgtgtatgatgcaattgcaacatataaatgcaaatgtactagatgacgatgttgttcgttgtccaattta

SEQ ID NO: 2692 - protein, 518 aa, Arabidopsis thaliana
  G1666
MDESSIIPAEKVAGAEKKELQGLLKTAVQSVDWTYSVFWQFCPQQRVLVWGNGYYNGAIKTRKTTQPAEVTAEEAALERSQQLRELYETLLAGESTSEARACTALSPEDLTETEWFYLMCVSFSFPPPSGMPGKAYARRKHVWLSGANEVDSKTFSRAILAKSAKIQTVVCIPMLDGVVELGTTKKVREDVEFVELTKSFFYDHCKTNPKPALSEHSTYEVHEEAEDEEEVEEEMTMSEEMRLGSPDDEDVSNQNLHSDLHIESTHTLDTHMDMMNLMEEGGNYSQTVTTLLMSHPTSLLSDSVSTSSYIQSSFATWRVENGKEHQQVKTAPSSQWVLKQMIFRVPFLHDNTKDKRLPREDLSHVVAERRRREKLNEKFITLRSMVPFVTKMDKVSILGDTIAYVNHLRKRVHELENTHHEQQHKRTRTCKRKTSEEVEVSIIENDVLLEMRCEYRDGLLLDILQVLHELGIETTAVHTSVNDHDFEAEIRAKVRGKKASIAEVKRAIHQVIIHDTNL

SEQ ID NO: 2693 - DNA, 898 bp, Arabidopsis thaliana
  G1671
tcccactatccttcgcaagacccttcctctatataaggaagttcatttcatttggagaggacacgctgacaagctgactctagcagatctggtaccgtcgaccctctctatataatcttcttctacacacacacacacacgcaaccatatacgtacatgtgaagtagtgagatcaatatcgttagcaatgaatctaccaccgggatttaggttttttccgaccgatgaagagctcgtcgttcacttcctccaccggaaagcttccctcttgccttgtcaccctgatgtcatccccgaccttgatctttaccattacgatccttgggaccttcccgggaaagctttgggagaagggaggcaatggtacttctatagtagaaagacacaagagagagtgacaagcaatgggtattggggatcaatgggaatggacgagccaatctacacaagctccacacacaagaaagtgggaatcaaaaagtatctaactttctatctcggagattctcagactaattggatcatgcaagaatattccctcccggattcctcttcttcatctagtcgatcttctaagagatcaagccgtgcttctagttctagtcacaaacccgattatagcaagtgggtgatatgcagagtgtatgagcaaaattgcagtgaggaggaagacgatgatgggacagaactctcatgtttggatgaagtgtttttgtctttagatgatcttgacgaagtaagcttaccgtaataaagacagaagcacccaagaagagaaaaaaaaaaaaagggtttagtgggcaattatttctaagcgaccgctctagacaggcctagtaccggatcctctagctagagctttcgttcgtatcatcggtttcgacaacgttcgtcaagt

SEQ ID NO: 2694 - protein, 187 aa, Arabidopsis thaliana
  G1671
MNLPPGFRFFPTDEELVVHFLHRKASLLPCHPDVIPDLDLYHYDPWDLPGKALGEGRQWYFYSRKTQERVTSNGYWGSMGMDEPIYTSSTHKKVGIKKYLTFYLGDSQTNWIMQEYSLPDSSSSSSRSSKRSSRASSSSHKPDYSKWVICRVYEQNCSEEEDDDGTELSCLDEVFLSLDDLDEVSLP

SEQ ID NO: 2695 - DNA, 777 bp, Arabidopsis thaliana
  G1747
atgaaaatgatgcaagaggagggaaaccgaaaaggtccatggacagaacaggaagacatacttctggtaaattttgttcacttatttggagatcgacgatgggattttatagcaaaagtatcaggtttgaacagaacaggaaagagttgcaggctaagatgggttaattacctacatcctggtctcaaacgtggcaagatgacgcctcaagaagagcgcctcgtccttgagcttcacgctaagtggggaaacaggtggtcgaaaatagcccgaaaattgccgggacgaacggataacgagataaagaactactggaggactcatatgaggaagaaagctcaagaaaagaagcgtcctgtttccccaacttcctcattttccaactgcagctcgtcatctgtgaccactaccaccaccaatactcaagatacatcgtgccactcgcgtaaatcttcaggggaagtgagcttttacgacactggaggttcccgatccactagagagatgaatcaagaaaacgaagacgtgtactcgttggatgatatatggagagagattgatcactcagcagtaaacataataaaaccggttaaagacatctactcagaacaaagccattgcttaagttacccaaatctagcttcaccatcatgggaaagctcattggattctatatggaacatggatgcagataaaagtaagatatcgtcttactttgcaaatgatcagtttcctttctgtttccaacacagtagatcaccatggtcgtcaggttaa

SEQ ID NO: 2696 - protein, 258 aa, Arabidopsis thaliana
  G1747
MKMMQEEGNRKGPWTEQEDILLVNFVHLFGDRRWDFIAKVSGLNRTGKSCRLRWVNYLHPGLKRGKMTPQEERLVLELHAKWGNRWSKIARKLPGRTDNEIKNYWRTHMRKKAQEKKRPVSPTSSFSNCSSSSVTTTTTNTQDTSCHSRKSSGEVSFYDTGGSRSTREMNQENEDVYSLDDIWREIDHSAVNIIKPVKDIYSEQSHCLSYPNLASPSWESSLDSIWNMDADKSKISSYFANDQFPFCFQHSRSPWSSG

SEQ ID NO: 2697 - DNA, 1123 bp, Arabidopsis thaliana
  G1751
aaacacaaacaaaactcatattttcaatctccaggtgctttacaccaacagagtcgcaagaaaacaaaaaccaaactcggatttagtttgacagaagaaggaatcgagagtcgggtatgcattatcctaacaacagaaccgaattcgtcggagctccagccccaacccggtatcaaaaggagcagttgtcaccggagcaagagctttcagttattgtctctgctttgcaacacgtgatctcaggggaaaacgaaacggcgccgtgtcagggtttttccagtgacagcacagtgataagcgcgggaatgcctcggttggattcagacacttgtcaagtctgtaggatcgaaggatgtctcggctgtaactactttttcgcgccaaatcagagaattgaaaagaatcatcaacaagaagaagagattactagtagtagtaacagaagaagagagagctctcccgtggcgaagaaagcggaaggtggcgggaaaatcaggaagaggaagaacaagaagaatggttacagaggagttaggcaaagaccttggggaaaatttgcagctgagatcagagatcctaaaagagccacacgtgtttggcttggtactttcgaaaccgccgaagatgcggctcgagcttatgatcgagccgcgattggattccgtgggccaagggctaaactcaacttcccctttgtggattacacgtcttcagtttcatctcctgttgctgctgatgatataggagcaaaggcaagtgcaagcgccagtgtgagcgccacagattcagttgaagcagagcaatggaacggaggaggaggggattgcaatatggaggagtggatgaatatgatgatgatgatggattttgggaatggagattcttcagattcaggaaatacaattgctgatatgttccagtgataaatgagctctttcttgttggcgttttttggagttaagtgcaagaagagattgacactgtggcttgtttaaagtgaacaagaacaagaaagcatgtaattagtagtctcattcttttgtttgtggtcaattctatgtttatctcatataaaatctgagttaaacctatctgaggagagagtaaataaagaggttaagaa

SEQ ID NO: 2698 - protein, 268 aa, Arabidopsis thaliana
  G1751
MHYPNNRTEFVGAPAPTRYQKEQLSPEQELSVIVSALQHVISGENETAPCQGFSSDSTVISAGMPRLDSDTCQVCRIEGCLGCNYFFAPNQRIEKNHQQEEEITSSSNRRRESSPVAKKAEGGGKIRKRKNKKNGYRGVRQRPWGKFAAEIRDPKRATRVWLGTFETAEDAARAYDRAAIGFRGPRAKLNFPFVDYTSSVSSPVAADDIGAKASASASVSATDSVEAEQWNGGGGDCNMEEWMNMMMMMDFGNGDSSDSGNTIADMFQ

SEQ ID NO: 2699 - DNA, 933 bp, Arabidopsis thaliana
  G1752
aaaaaaaaaaaaaaaaaaaaacttatggaatattcccaatcttccatgtattcatctccaagttcttggagctcatcacaagaatcactcttatggaacgagagctgtttcttggatcaatcatctgaacctcaagccttcttttgccctaattatgattactccgatgactttttctcatttgagtcaccggagatgatgattaaggaagaaattcaaaacggcgacgtttctaactccgaagaagaagaaaaggttggaattgatgaagaaagatcatacagaggagtgaggaaaaggccgtgggggaaatttgcagcggagataagagattcaacgaggaatggaattagggtttggctcgggacatttgacaaagccgaggaagccgctcttgcttatgatcaagcggctttcgccacaaaaggatctcttgcaacacttaatttcccggtggaagtggttagagagtcgctaaagaaaatggagaatgtgaatcttcatgatggaggatctccggttatggccttgaagagaaaacattctcttcgaaaccggcctagagggaaaaagcgatcctcttcttcttcttcttcttcttctaattcttcttcttgctcttcttcttcgtctacttcttcaacatcaagaagtagtagtaagcagagtgttgtgaagcaagaaagtggtacacttgtggtttttgaagatttaggtgctgagtatttagaacaacttcttatgagctcatgttgatcttgtaattgatttcagcaaaagccactattaaactttaattttgtgataattaatcttgaaatttgttttgttcattctgcaatttctttggttctcttattttttgtttgttgtatccaaatgaaattattggaagagatggtgatgttaaagtgtatatatataaaaaaaaaa

SEQ ID NO: 2700 - protein, 243 aa, Arabidopsis thaliana
  G1752
MEYSQSSMYSSPSSWSSSQESLLWNESCFLDQSSEPQAFFCPNYDYSDDFFSFESPEMMIKEEIQNGDVSNSEEEEKVGIDEERSYRGVRKRPWGKFAAEIRDSTRNGIRVWLGTFDKAEEAALAYDQAAFATKGSLATLNFPVEVVRESLKKMENVNLHDGGSPVMALKRKHSLRNRPRGKKRSSSSSSSSSNSSSCSSSSSTSSTSRSSSKQSVVKQESGTLVVFEDLGAEYLEQLLMSSC

SEQ ID NO: 2701 - DNA, 1432 bp, Arabidopsis thaliana
  G1757
  misc_feature (1419)..(1419): n is a, c, g, or t
atcaccaatcctataacactctcattctcatcatatcattcttcaatctatataacccattcttaattatactcaacacacattatatttttctgatcatatcattctttcagtccatctatataaccaattcttgatttatacttaaaacacacattatacatctttctcatcatagtttgtatcaatttcctagagtaaactacctaaaggaaaaaaaaaatctattttgggaatcatatactaaaaatggaaggaagagatatgttaagttgggagcaaaagacattgctaagcgagcttatcaatggatttgatgcggccaaaaagcttcaggcacgacttagagaagctccgtcgccgtcgtcatcattttcatcaccggcgacggctgttgctgagactaacgagattctggtgaagcagatagtttcttcctacgagagatctcttcttctgctaaactggtcatcctcaccgagcgtacaacttattccgacgccggttactgtagtcccggtggcaaatcccggcagtgttccagaatctccggcatcgataaacggaagtccgagaagtgaagagtttgccgatggaggaggttctagcgagagtcatcatcgccaagattacattttcaattcaaagaaaagaaagatgttaccaaagtggtcagaaaaagtgagaataagcccagagagaggcttagaaggacctcaagatgatgtctttagctggagaaaatatggtcaaaaagacattttaggcgccaaattcccaaggagttattacagatgcacacatcgtagcacacaaaactgttgggcaacgaaacaagtccagagatcagacggggatgctacggttttcgaagtgacgtacagaggaacacacacttgttcgcaggcgatcacaagaacaccaccattagcctcgccggagaagcgacaagacaccagagtcaaaccagccattacccaaaagccaaaggatattctcgagagtcttaaatccaacttaaccgttcgaaccgatgggcttgatgatggtaaagacgttttctcgttccctgatacgccgccgttttacaattacggaactatcaacggcgagttcggccacgtggagagttctccgatcttcgacgttgttgactggttcaatccaacggtcgagattgacacaactttccccgcgtttttacacgagtcgatttattattaattaaaatttgtaacagagaaatagatagtaactagtaagtaatgatcagcgagagttaaaacataaaagtacttagagtaatctaacgatgcataataaggaatgttcaacaggacttgaacatgatttcaatactaagagagatttatctagctactggtagtagccgcagacttcttgttgtagcttcacttnctttttgttgctt

SEQ ID NO: 2702 - protein, 324 aa, Arabidopsis thaliana
  G1757
MEGRDMLSWEQKTLLSELINGFDAAKKLQARLREAPSPSSSFSSPATAVAETNEILVKQIVSSYERSLLLLNWSSSPSVQLIPTPVTVVPVANPGSVPESPASINGSPRSEEFADGGGSSESHHRQDYIFNSKKRKMLPKWSEKVRISPERGLEGPQDDVFSWRKYGQKDILGAKFPRSYYRCTHRSTQNCWATKQVQRSDGDATVFEVTYRGTHTCSQAITRTPPLASPEKRQDTRVKPAITQKPKDILESLKSNLTVRTDGLDDGKDVFSFPDTPPFYNYGTINGEFGHVESSPIFDVVDWFNPTVEIDTTFPAFLHESIYY

SEQ ID NO: 2703 - DNA, 896 bp, Arabidopsis thaliana
  G1758
gtccctcctcttagcttcaaccgccggaaaaactaaacaaccttcttggaaaaaaagagaaactaaaaatgaactatccttcaaaccctaaccctagctccacagatttcactgaatttttcaagttcgatgattttgacgatacttttgagaagatcatggaagaaatcggccgtgaggaccactcgtcgtcaccgactttgagttggagttcatcggaaaagttagtggctgcagaaatcacaagcccgcttcaaacaagcctagctacctcacctatgagctttgaaataggtgacaaagatgaaatcaaaaagaggaagagacacaaagaagatccgattattcacgtcttcaaaacgaaatcatcaattgatgaaaaggttgctttagatgatgggtataaatggaggaaatacggaaagaagccgataacgggtagtccatttccaaggcattatcacaagtgttcgagcccagattgcaacgtgaagaagaagatcgaaagagatacgaacaatccagattacatattgacaacatacgaaggtagacataaccacccaagcccttctgtagtttattgtgattcagacgactttgatcttaactctctcaacaattggtcctttcagacggcaaatacgtatagtttctctcattctgctccatattgatcgatcgtagttacaagtttgtgtatatagatgtatatatatatatcaccaattcaccatcgtaatcacgtctcacatgtaactacgtacatatatcttgttcggggttcgttttgtaatgtattgaattggtggaggtagaatggaagtcatcttgtatagttgtacttgtatgtaaggtttgatagtcattttttataaagtaactaatttgtacaa

SEQ ID NO: 2704 - protein, 202 aa, Arabidopsis thaliana
  G1758
MNYPSNPNPSSTDFTEFFKFDDFDDTFEKIMEEIGREDHSSSPTLSWSSSEKLVAAEITSPLQTSLATSPMSFEIGDKDEIKKRKRHKEDPIIHVFKTKSSIDEKVALDDGYKWRKYGKKPITGSPFPRHYHKCSSPDCNVKKKIERDTNNPDYILTTYEGRHNHPSPSVVYCDSDDFDLNSLNNWSFQTANTYSFSHSAPY

SEQ ID NO: 2705 - DNA, 1135 bp, Arabidopsis thaliana
  G1763
gtacatttttttttgtatttcaggaaactccgatggcggatctcttcggtggtggccacggcggcgagcttatggaagcacttcaacctttttacaaaagtgcttccacgtctgcttcaaatcctgcgtttgcgtcctcaaacgatgcgtttgcgtctgccccaaacgacccattttcttcttcttcttactataatcctcatgcatctttcttcccttcacattccacaaccacttacccggatatttattctggatccatgacctatccatcttcattcgggtcggatcttcaacaacccgaaaactaccaatctcagttccattaccaaaacactatcacttacactcaccaagacaacaacacttgcatgctcaacttcattgagccgagccaaccggattttatgacccaaccgggtccgagttcgggttcggtttcaaaaccggctaagctctatagaggagtgaggcaaagacattggggaaaatgggtcgcggagatccgtttacccaggaaccgaacccgactttggctcggaacattcgacacggctgaagaagccgcgttggcttatgatcgcgccgcgtttaagcttcgtggtgactcggctcggcttaacttcccagctctccgataccaaaccggctcgtctccgtctgacgttggcgaatacggacctattcaagctgccgttgacgccaagctagaagccatattagctgagccgaagaatcagccgggcaaaacggagaggacgtcgaggaaacgagctaaagccgcggcttcttcagctgagcagccgtcagcgccacaacaacattccgggtcgggtgaaagtgatgggtcgggttcaccgacttcggatgttatggtgcaggagatgtgccaagagccagagatgccatggaatgaaaatttcatgctcggcaagtgtccttcttatgagatagattgggcttcaattttatcgtgaaaaattaggattcaattcatttttattcattttaacttgtttgtattttcttttaaactttagggttattagctgtgcgtaaaatttgtaatttagcattttgtatgaatgtaatgcaagtgtgtaaattatggacagctcaagcttttttgttaaaa

SEQ ID NO: 2706 - protein, 314 aa, Arabidopsis thaliana
  G1763
MADLFGGGHGGELMEALQPFYKSASTSASNPAFASSNDAFASAPNDPFSSSSYYNPHASFFPSHSTTTYPDIYSGSMTYPSSFGSDLQQPENYQSQFHYQNTITYTHQDNNTCMLNFIEPSQPDFMTQPGPSSGSVSKPAKLYRGVRQRHWGKWVAEIRLPRNRTRLWLGTFDTAEEAALAYDRAAFKLRGDSARLNFPALRYQTGSSPSDVGEYGPIQAAVDAKLEAILAEPKNQPGKTERTSRKRAKAAASSAEQPSAPQQHSGSGESDGSGSPTSDVMVQEMCQEPEMPWNENFMLGKCPSYEIDWASILS

SEQ ID NO: 2707 - DNA, 1410 bp, Arabidopsis thaliana
  G1766
aggctattctcggaaaaacaaagaataaagaatgaattcgttttcacaagtacctcctggcttcagatttcatcctactgatgaagaacttgtagactactacttgaggaaaaaagttgcatcaaagagaatagaaatcgatatcatcaaggatgttgatctttacaagattgagccatgtgatcttcaagagttatgcaagataggaaacgaagagcagagcgaatggtacttctttagtcataaagacaagaagtatcccacgggaactcgaaccaatagagccacgaaagcaggattttggaaagccactggaagagacaaggctatatatataagacatagtcttatcggtatgaggaaaacacttgtgttttacaaaggaagagccccaaatggtcagaaatccgattggatcatgcacgaatatcgcttagaaacaagtgaaaatggaacccctcaggaagaaggatgggtagtatgtagggtattcaagaagaaattggcagcgacagtgaggaaaatgggagattaccattcatcaccatcgcagcattggtacgatgatcagctctcttttatggcctccgagatcatttctagttctccacgacagtttcttcccaatcatcattataaccgccaccatcaccagcagacattgccttgtggcctcaatgcattcaacaacaacaatcctaacttgcaatgcaagcaagagctcgagttacattacaatcaaatggtacaacatcaacaacaaaaccatcatcttcgtgaatctatgtttctccagcttcctcagctcgaaagccctaccagtaattgcaattctgacaacaacaataacacaagaaatattagtaacttgcagaaatcatcaaatatatctcatgaggaacaattgcaacaagggaatcaaagtttcagctctctgtattacgatcaaggagtagagcaaatgactactgactggagagttctcgataaatttgttgcttcacagcttagcaatgatgaagaggctgcagccgtggtttcttcttcttctcatcaaaacaacgtcaagattgacacgagaaacacgggttatcatgtgatagatgagggaataaatttgccggagaatgattctgaaagggttgttgaaatgggagaagagtattcaaatgctcatgctgcttctacttcttcaagttgtcagattgatctctagaaatagtgatagagagatgaaaaagatgcaaggtgaatatatatgaaaatacatgcacactagtgttatttatacttaaagatggaaggggaaaaacaaggagttatttcctggatttatggaggttttgtacataataaaaacctacaaccatatggtattttcttttgaaaaaaaaaaaaaaaaaaaaaaaa

SEQ ID NO: 2708 - protein, 394 aa, Arabidopsis thaliana
  G1766
MNSFSQVPPGFRFHPTDEELVDYYLRKKVASKRIEIDIIKDVDLYKIEPCDLQELCKIGNEEQSEWYFFSHKDKKYPTGTRTNRATKAGFWKATGRDKAIYIRHSLIGMRKTLVFYKGRAPNGQKSDWIMHEYRLETSENGTPQEEGWVVCRVFKKKLAATVRKMGDYHSSPSQHWYDDQLSFMASEIISSSPRQFLPNHHYNRHHHQQTLPCGLNAFNNNNPNLQCKQELELHYNQMVQHQQQNHHLRESMFLQLPQLESPTSNCNSDNNNNTRNISNLQKSSNISHEEQLQQGNQSFSSLYYDQGVEQMTTDWRVLDKFVASQLSNDEEAAAVVSSSSHQNNVKIDTRNTGYHVIDEGINLPENDSERVVEMGEEYSNAHAASTSSSCQIDL

SEQ ID NO: 2709 - DNA, 1596 bp, Arabidopsis thaliana
  G1767
atggatactctctttagactagtcagtctccaacaacaacaacaatccgatagtatcattacaaatcaatcttcgttaagcagaacttccaccaccactactggctctccacaaactgcttatcactacaactttccacaaaacgacgtcgtcgaagaatgcttcaactttttcatggatgaagaagacctttcctcttcttcttctcaccacaaccatcacaaccacaacaatcctaatacttactactctcctttcactactcccacccaataccatcccgccacatcatcaaccccttcctccaccgccgcagccgcagctttagcctcgccttactcctcctccggccaccataatgacccttccgcgttctccatacctcaaactcctccgtccttcgacttctcagccaatgccaagtgggcagactcggtccttcttgaagcggcacgtgccttctccgacaaagacactgcacgtgcgcaacaaatcctatggacgctcaacgagctctcttctccgtacggagacaccgagcaaaaactggcttcttacttcctccaagctctcttcaaccgcatgaccggttcaggcgaacgatgctaccgaaccatggtaacagctgcagccacagagaagacttgctccttcgagtcaacgcgaaaaactgtactaaagttccaagaagttagcccctgggccacgtttggacacgtggcggcaaacggagcaatcttggaagcagtagacggagaggcaaagatccacatcgttgacataagctccacgttttgcactcaatggccgactcttctagaagctttagccacaagatcagacgacacgcctcacctaaggctaaccacagttgtcgtggccaacaagtttgtcaacgatcaaacggcgtcgcatcggatgatgaaagagatcggaaaccgaatggagaaattcgctaggcttatgggagttcctttcaaatttaacattattcatcacgttggagatttatctgagtttgatctcaacgaactcgacgttaaaccagacgaagtcttggccattaactgcgtaggcgcgatgcatgggatcgcttcacgtggaagccctagagacgctgtgatatcgagtttccgacggttaagaccgaggattgtgacggtcgtagaagaagaagctgatcttgtcggagaagaagaaggtggctttgatgatgagttcttgagagggtttggagaatgtttacgatggtttagggtttgcttcgagtcatgggaagagagttttccaaggacgagcaacgagaggttgatgctagagcgtgcagcgggacgtgcgatcgttgatcttgtggcttgtgagccgtcggattccacggagaggcgagagacagcgaggaagtggtcgaggaggatgaggaatagtgggtttggagcggtggggtatagtgatgaggtggcggatgatgtcagagctttgttgaggagatataaagaaggtgtttggtcgatggtacagtgtcctgatgccgccggaatattcctttgttggagagatcagccggtggtttgggctagtgcgtggcggccaacgtaa

SEQ ID NO: 2710 - protein, 531 aa, Arabidopsis thaliana
  G1767
MDTLFRLVSLQQQQQSDSIITNQSSLSRTSTTTTGSPQTAYHYNFPQNDVVEECFNFFMDEEDLSSSSSHHNHHNHNNPNTYYSPFTTPTQYHPATSSTPSSTAAAAALASPYSSSGHHNDPSAFSIPQTPPSFDFSANAKWADSVLLEAARAFSDKDTARAQQILWTLNELSSPYGDTEQKLASYFLQALFNRMTGSGERCYRTMVTAAATEKTCSFESTRKTVLKFQEVSPWATFGHVAANGAILEAVDGEAKIHIVDISSTFCTQWPTLLEALATRSDDTPHLRLTTVVVANKFVNDQTASHRMMKEIGNRMEKFARLMGVPFKFNIIHHVGDLSEFDLNELDVKPDEVLAINCVGAMHGIASRGSPRDAVISSFRRLRPRIVTVVEEEADLVGEEEGGFDDEFLRGFGECLRWFRVCFESWEESFPRTSNERLMLERAAGRAIVDLVACEPSDSTERRETARKWSRRMRNSGFGAVGYSDEVADDVRALLRRYKEGVWSMVQCPDAAGIFLCWRDQPVVWASAWRPT

SEQ ID NO: 2711 - DNA, 1634 bp, Arabidopsis thaliana
  G1768
cttccttttgcttcagctgcgagctttggttggatctctcacttgcaaaaccaaatcccttatcgacttccaccgaaagatcacttcttaacctacacaaggtgtttgttatgaagatcagataaataaaaggtcatttgaggataatggttgatgttcaaagattcttacttgcttatttgtgatggacaatgtaagaggttcaataatgttgcagccactgccagagatagctgagagtatcgatgatgctatctgccatgaactctccatgtggcctgatgatgctaaagatttgttattgatagtggaggcaatatcaaggggagacttgaagttggtacttgttgcttgtgcaaaagctgtttctgagaataatcttctaatggcacgatggtgtatgggtgagttgcgcggtatggtttcgatttctggtgagccaatccagagattgggagcttatatgttagaagggcttgttgctaggcttgctgcttctggtagttcgatatataagtctctccagtccagagaaccagagagttatgaatttttatcttatgtgtatgttctgcatgaggtttgtccatatttcaagtttggatacatgtcagcgaatggtgcgattgcagaagcaatgaaggatgaagagaggattcacattattgacttccaaattggacaagggagccagtggatagcacttatccaggcttttgcagctaggcctggtggggctccaaatattcgaattaccggagttggtgatggatctgtcttggttacagtcaagaagagactagagaaacttgcaaagaagtttgatgttccattcaggttcaatgcggtttcaaggccaagttgtgaagttgaagtggaaaatcttgatgtccgagatggcgaagcccttggagtgaactttgcttacatgctgcatcatttgccagatgagagtgtaagcatggaaaaccacagggaccggttgctgaggatggtgaagagtctatcacctaaagtagtcactcttgtggaacaagaatgcaacacgaacacttcccctttccttcctaggttccttgagacattaagttattacacggcaatgttcgaatctatcgatgttatgcttccgagaaatcacaaggaaaggatcaatatcgagcagcactgcatggcaagggatgtcgtcaacatcatagcttgtgaaggagccgagaggatcgaaagacacgagcttctcgggaaatggaagtcaaggttttccatggcgggttttgagccataccccttgagctcaatcatttcagccaccattagagccctcttgagagattacagcaacgggtatgcgattgaagaaagagatggtgctctgtaccttggttggatggaccgaatcttggtctcatcttgtgcatggaagtgaaagaataaacgtctccaagaatgtaatgcaaaagacagaactggaagtaatagatagttttgtctcataaccattaataaggttgaatcaaatcatatacatccccatgctacaactattacacaggctccatcaacaaagaagggctcttgttgtgttaccttctcttcctgtaactcttatttgaaccaaatggaagtggttacat

SEQ ID NO: 2712 - protein, 413 aa, Arabidopsis thaliana
  G1768
MDNVRGSIMLQPLPEIAESIDDAICHELSMWPDDAKDLLLIVEAISRGDLKLVLVACAKAVSENNLLMARWCMGELRGMVSISGEPIQRLGAYMLEGLVARLAASGSSIYKSLQSREPESYEFLSYVYVLHEVCPYFKFGYMSANGAIAEAMKDEERIHIIDFQIGQGSQWIALIQAFAARPGGAPNIRITGVGDGSVLVTVKKRLEKLAKKFDVPFRFNAVSRPSCEVEVENLDVRDGEALGVNFAYMLHHLPDESVSMENHRDRLLRMVKSLSPKVVTLVEQECNTNTSPFLPRFLETLSYYTAMFESIDVMLPRNHKERINIEQHCMARDVVNIIACEGAERIERHELLGKWKSRFSMAGFEPYPLSSIISATIRALLRDYSNGYAIEERDGALYLGWMDRILVSSCAWK

SEQ ID NO: 2713 - DNA, 627 bp, Arabidopsis thaliana
  G1778
atgatgggataccaaacaaactctaatttctccatgtttttttcctcggaaaatgacgaccaaaaccaccacaactacgatccttataataatttctcttcatcaacttctgttgattgcactctctcacttggaacaccctctactcgtctcgacgaccaccatagattttcttctgctaattctaacaacatctccggcgacttttatattcacggaggaaacgctaagacttcttcgtacaagaagggtggtgttgctcatagcctacctcgccgttgtgctagctgcgacaccacttcaactcctctatggagaaacggaccaaaaggacctaagtcgttatgtaacgcgtgtggaatccgattcaagaaagaggagaggcgtgcgacggccagaaacttaacgatctccggtggaggttcatcagcggcagaagtcccagtagagaattcgtacaacggaggtggaaactattacagtcatcatcatcatcactatgcctcgtcgtcgccgtcgtgggctcatcagaacacacaaagagttccatatttctcaccggttccggagatggaatatccctacgtggataacgtcacggcttcttcttttatgtcttggaattga

SEQ ID NO: 2714 - protein, 208 aa, Arabidopsis thaliana
  G1778
MMGYQTNSNFSMFFSSENDDQNHHNYDPYNNFSSSTSVDCTLSLGTPSTRLDDHHRFSSANSNNISGDFYIHGGNAKTSSYKKGGVAHSLPRRCASCDTTSTPLWRNGPKGPKSLCNACGIRFKKEERRATARNLTISGGGSSAAEVPVENSYNGGGNYYSHHHHHYASSSPSWAHQNTQRVPYFSPVPEMEYPYVDNVTASSFMSWN

SEQ ID NO: 2715 - DNA, 603 bp, Arabidopsis thaliana
  G1783
atggccgcgtttccgcagtggacaagggtcgatgacaaacgttttgagttagctctgcttcaaatcccggagggttcgccgaattttatagagaatatcgcctattatctccagaaaccggtgaaggaggtggagtactactactgcgcgttggtccatgatattgagcggatcgaatcgggtaagtatgttttgcccaaatacccggaagacgattacgtgaaactgacggaagcaggtgagtctaagggcaatgggaaaaagacgggaattccttggtcagaagaggaacagaggttgtttctggaaggactaaataagtttgggaaaggagactggaagaacatatcgaggtattgtgtgaagtcaaggacctcgacgcaagtggcaagccatgctcagaagtattttgcaaggcaaaagcaggagagtacgaatactaaacgcccgagtattcatgacatgactctgggagttgcggtcaatgtccctggatccaacttggagtctactggccagcaaccacattttggtgatcaaattccttcgaatcaatattatccctcccaggaaaactttcggggttttgatcagcgatggtga

SEQ ID NO: 2716 - protein, 200 aa, Arabidopsis thaliana
  G1783
MAAFPQWTRVDDKRFELALLQIPEGSPNFIENIAYYLQKPVKEVEYYYCALVHDIERIESGKYVLPKYPEDDYVKLTEAGESKGNGKKTGIPWSEEEQRLFLEGLNKFGKGDWKNISRYCVKSRTSTQVASHAQKYFARQKQESTNTKRPSIHDMTLGVAVNVPGSNLESTGQQPHFGDQIPSNQYYPSQENFRGFDQRW

SEQ ID NO: 2717 - DNA, 1170 bp, Arabidopsis thaliana
  G1786
atgatcgtgtacggtgggggagcatccgaggacggtgaaggtggaggggtggttctgaagaaagggccatggacggtggccgaggacgagacactggcggcttacgtacgggaatacggtgaagggaactggaattctgttcagaagaagacatggctggctaggtgtggcaagagctgccgcctccgctgggctaaccacttacgacctaatctcaggaaaggctccttcacccccgaggaagaacgtctcatcatacaactccactctcagctaggcaacaaatgggctcgcatggctgctcagttaccaggcagaacagataacgagatcaagaactactggaacacgaggttgaaacgcttccaacgccaaggcctccctctctaccctccagaatattcccaaaacaatcatcaacaacaaatgtatcctcaacagccctcctcacctctcccgtcccaaacacctgcttcttcctttacctttcctctcctccaaccgccttctctgtgtcccaaacgttgttataacactgccttctctcccaaggcctcatatatttcttctccaaccaatttccttgtctcgtctccgacctttcttcacacccattcctctctttcctcctatcagtctaccaatccggtttactccatgaaacatgagctctcttcaaaccaaattccatactctgcctctttaggagtctatcaagtaagcaagttctcagacaatggggattgtaaccaaaacctgaacaccggtttgcatacaaatacctgtcagctgttagaggatcttatggaggaggccgaggctctagctgatagctttcgtgctcctaagcggagacaaatcatggctgcgcttgaggacaacaacaacaacaacaactttttctcgggaggtttcggacatcgtgtttcttccaacagtctatgttccttgcaaggtttaacaccaaaggaagatgagtctctccagatgaacacaatgcaagatgaggacataacaaagcttcttgactggggaagtgaaagtgaagaaatctcaaacgggcaatcctctgtgataacaacagagaacaaccttgtccttgacgatcaccagttcgcttttctgtttccagttgatgatgacaccaacaacttgccagggatctgctag

SEQ ID NO: 2718 - protein, 389 aa, Arabidopsis thaliana
  G1786
MIVYGGGASEDGEGGGVVLKKGPWTVAEDETLAAYVREYGEGNWNSVQKKTWLARCGKSCRLRWANHLRPNLRKGSFTPEEERLIIQLHSQLGNKWARMAAQLPGRTDNEIKNYWNTRLKRFQRQGLPLYPPEYSQNNHQQQMYPQQPSSPLPSQTPASSFTFPLLQPPSLCPKRCYNTAFSPKASYISSPTNFLVSSPTFLHTHSSLSSYQSTNPVYSMKHELSSNQIPYSASLGVYQVSKFSDNGDCNQNLNTGLHTNTCQLLEDLMEEAEALADSFRAPKRRQIMAALEDNNNNNNFFSGGFGHRVSSNSLCSLQGLTPKEDESLQMNTMQDEDITKLLDWGSESEEISNGQSSVITTENNLVLDDHQFAFLFPVDDDTNNLPGIC

SEQ ID NO: 2719 - DNA, 578 bp, Arabidopsis thaliana
  G1789
caaggactctgcgacatctgtgcaacatatcatttcctcagaatctctttcttttctaggtttattactacacaaaaccaaacatcatcaactttagttactaaacaatggcatcaggctcaatgtcttcttatggctctggctcatggactgttaagcagaacaaagcctttgagcgtgctctagcagtctatgaccaagacactccggaccgttggcacaatgttgctagagctgttggtggtaaaacaccagaagaagctaagagacagtatgaccttctagttcgtgacatcgaaagcatcgagaatggtcacgtgccattccctgactacaagactactacaggaaacagcaacagaggcaggctgcgtgatgaggaaaagaggatgagaagcatgaagctgcagtgagacaagaagcaacaaaacctaactacgtatgatcgtcaaaataaaagagaatcacttcagagagatgtgtttttttcaatgtctgacgaatcaatgtttttttcttgcaatttctcatgtttttccctaagaaatggtttttttttcgaggcaacaaaaaaaaaa

SEQ ID NO: 2720 - protein, 101 aa, Arabidopsis thaliana
  G1789
MASGSMSSYGSGSWTVKQNKAFERALAVYDQDTPDRWHNVARAVGGKTPEEAKRQYDLLVRDIESIENGHVPFPDYKTTTGNSNRGRLRDEEKRMRSMKLQ

SEQ ID NO: 2721 - DNA, 1484 bp, Arabidopsis thaliana
  G1790
gaaaaagacttcactttttttttttactaattaattagtttttttttctcctttccaaaacaatggagaatttcgtcgacgagaatggttttgcttctctaaaccaaaacatcttcacacgtgatcaagaacacatgaaagaagaagattttccattcgaagtcgtcgaccaatcaaaacctacaagctttcttcaagattttcaccatcttgatcatgatcatcagtttgatcatcatcatcatcatggctcctcatcttcacatcctttgctcagcgtccaaactacgtcttcttgtatcaataatgctcctttcgagcattgctcttaccaagaaaacatggtcgatttctatgaaactaaaccaaatttgatgaatcatcatcatttccaagcagtggaaaactcatacttcactcgtaatcatcatcatcatcaagagatcaatttggtcgatgaacatgatgatcctatggacttggagcaaaacaacatgatgatgatgaggatgatcccttttgattaccctcctacagagactttcaaacctatgaacttcgtaatgccagatgaaatttcatgtgtttctgcagataatgattgttatagagcaacgagtttcaacaagaccaaaccatttcttacacgaaagttgtcttcttcttcttcatcatcatcatggaaagaaaccaaaaagtcaaccttagtcaaaggacaatggactgctgaagaagacagggtactgattcaactcgtggagaagtatggattgcgtaaatggtcgcatatcgctcaagtgttaccgggaagaatcgggaaacaatgtagagagaggtggcataaccatttgagacctgacattaagaaagaaacatggagtgaagaagaggacagagtgttgatagaatttcacaaagagattggaaacaaatgggcagagattgcgaaaagactcccgggaagaacagagaactcgatcaagaaccattggaacgcaacaaaaagaagacaattctctaaaagaaaatgtagatctaagtatccaagaccttctctgttgcaggattacatcaagagcttgaatatgggagctttgatggcttcttctgttcctgcaagaggtagacgcagagagagtaataacaagaagaaggatgttgttgttgcggttgaggagaagaagaaggaagaggaggtgtatggacaagacaggattgtgcctgaatgtgtgtttactgatgattttggattcaatgagaagctgcttgaggaaggatgtagcattgactctttgcttgatgacattcctcagcctgacattgatgcttttgttcatgggctctgatttgtattttttattctgcttgtttcagttttgttgttttttgtttgtctttttatacgagacagattccaccaaacttcaataatttgaaaagatataaaatattttgctttttaaaaaaaaaaaaaaaaaaaaaaa

SEQ ID NO: 2722 - protein, 427 aa, Arabidopsis thaliana
  G1790
MENFVDENGFASLNQNIFTRDQEHMKEEDFPFEVVDQSKPTSFLQDFHHLDHDHQFDHHHHHGSSSSHPLLSVQTTSSCINNAPFEHCSYQENMVDFYETKPNLMNHHHFQAVENSYFTRNHHHHQEINLVDEHDDPMDLEQNNMMMMRMIPFDYPPTETFKPMNFVMPDEISCVSADNDCYRATSFNKTKPFLTRKLSSSSSSSSWKETKKSTLVKGQWTAEEDRVLIQLVEKYGLRKWSHIAQVLPGRIGKQCRERWHNHLRPDIKKETWSEEEDRVLIEFHKEIGNKWAEIAKRLPGRTENSIKNHWNATKRRQFSKRKCRSKYPRPSLLQDYIKSLNMGALMASSVPARGRRRESNNKKKDVVVAVEEKKKEEEVYGQDRIVPECVFTDDFGFNEKLLEEGCSIDSLLDDIPQPDIDAFVHGL

SEQ ID NO: 2723 - DNA, 1107 bp, Arabidopsis thaliana
  G1800
ccattatcatatcctcttcttccttcttcactatcaatcttcttctccactacaacacaaatggagaaatcatcctcaatgaaacaatggaagaagggtcctgctcggggtaaaggcggtccacaaaacgctctttgtcagtaccgtggagtcaggcaaaggacttggggcaaatgggtggctgagatcagagagcccaagaagagggcaagactttggcttggctctttcgctacagctgaagaagcagctatggcttatgatgaggctgccttgaaactctatgggcacgacgcatacctcaacttacctcatcttcagcggaatacaagaccttctctgagtaactctcagaggttcaaatgggtaccttcaaggaagtttatatctatgtttccttcatgtggtatgctaaacgtgaatgctcagcctagtgttcacataatccagcaaagactagaagaactcaagaaaactggacttttatctcaatcctattcttctagttcttcctccaccgaatcaaaaactaatactagctttcttgatgagaagaccagcaagggagaaacagacaatatgttcgaaggtggtgatcagaagaaaccagagatcgacctgaccgagtttcttcagcaactaggaatcttgaaggatgaaaatgaagcagaaccaagtgaggtagcagagtgtcattcccctccaccatggaacgagcaagaagaaactggaagtcctttcagaactgagaatttcagctgggataccctgatcgagatgccaagaagtgaaaccacaactatgcaatttgactccagcaacttcggaagctatgattttgaggatgatgtatccttcccttccatctgggactactacggaagcttagattgagtaaaagcaatttaaggtagatcaagattcagaagtacacaaatggttttggatttagtgtagcgttttggaaaagagacataggtagtgagagtgcagtcttttattatgcagcaataaagtgagtcagtgtacaaccgagttgttcgctttttttggtatattaatgaagcatgttcattttttcgctaaaaaaaaaaaaaaaaaaaaaaa

SEQ ID NO: 2724 - protein, 277 aa, Arabidopsis thaliana
  G1800
MEKSSSMKQWKKGPARGKGGPQNALCQYRGVRQRTWGKWVAEIREPKKRARLWLGSFATAEEAAMAYDEAALKLYGHDAYLNLPHLQRNTRPSLSNSQRFKWVPSRKFISMFPSCGMLNVNAQPSVHIIQQRLEELKKTGLLSQSYSSSSSSTESKTNTSFLDEKTSKGETDNMFEGGDQKKPEIDLTEFLQQLGILKDENEAEPSEVAECHSPPPWNEQEETGSPFRTENFSWDTLIEMPRSETTTMQFDSSNFGSYDFEDDVSFPSIWDYYGSLD

SEQ ID NO: 2725 - DNA, 2000 bp, Arabidopsis thaliana
  G1807
aggttagttctacacaaagcttgatcttttaggggttttctctagttattggagagtggtgagaattagaaactgcattatccgatctaaaatgggtgatacagagaagtgtaacagtgatatgatccagagacttcattcatctttcggcactacttcttcttccattcccaaaaatcccatttctcagctcgatttaaaccctaatttcatccgctcatcagctcctcaattctccaagcctttcagtgacagtggcaaacgaatcggtgttcctccgtcgcaccccaacttaatcccaccgacttctccgttttctcagatcccgaccacccgacaacccggttcgcataattttaacccgggaggagctaatcattcacggtcaatgtcacagcccaactctttcttctcttttgactccttacctccgttaagcccttctccgtttcgagatcacgatgtttcaatggaggatagagattccggcgtgtttaacagcaaccattcgttgcctccatcgccgttcacgaggtgtaattcgacctcttctagctccttgagagtcggtgagagtttacctccgagaaagtctcatagacgctccaacagtgatatccccagtgggtttaattcgatgcctttgatccctccgagaccattggagaggtctttttctggtggggagtgtgctgattggtcaaagtctaatccttttgtgaagaaggaatcgagctgcgaaagggaaggtgtcggagagagagaagctatggatgatctcttctcagcatatatgaatcttgaaaacattgatgtgttgaactcctctgaagctgatgatagcaagaacggtaatgagaatagggatgatatggagagcagcagagcaagcgggaccaagactaacggtagtgatacggaaggagagagcagcagtgtcaatgagagtgccaataataatatgaattcttctggtgaaaagagagagagcgtgaagagaagagcggctggaggagatattgctcctaccaccagacattacaggagtgtttcagtggacagttgtttcatggagaagttgtcttttggtgatgaatctctaaagccgcctccttctcctggatctatgtcaaggaaagtttcccctaccaattcggttgatgggaactcgggtgctgcttttagcatcgagttcaataacggtgagtttactgcagcggaaatgaagaagatcatggcaaatgataaactagcagagatggccatgtctgaccctaaacgtgtcaaaaggaatgatcctcttttcagaatcttagcgaaccgtcaatccgcagcacggtcaaaggagaggaagatgcggtacatagtagaattggaacacaaagtgcagactcttcagaccgaggctaccacattgtctgctcagctcacacttttgcagcgcgatatgatggggttgacaaatcagaacaatgagcttaagttccggcttcaagcaatggagcaacaagcgcgtcttcgcgatgctctgaacgaagcactgaatggagaagtccagcgactgaaactggcaatcggtgagagcagtcagaacgaatcagagagatcaaagatgcaatcactcaacgctgagatgttccagcaactcaacatcagccagttaagacagcagccacaacagatgcagcaacagtctcatcagcagaaccaccagaatggaaccatggcaacaaaatctgaatcaaatgaatagagcagagaagttgttgcggtggatcaaagggttggagtttttcaacaagttacatatcaaatcaaacattatatttcatttatgtgcagagtcagttgaatttacatatatatcatataagtccaagaaatttaattttacaatatgttgttatcttagaaagaaaaaattcaatttatagtagatataggtatgaactatgaacacaagttatatgtaatgggattgattgagcttcagacaaaaa

SEQ ID NO: 2726 - protein, 553 aa, Arabidopsis thaliana
  G1807
MGDTEKCNSDMIQRLHSSFGTTSSSIPKNPISQLDLNPNFIRSSAPQFSKPFSDSGKRIGVPPSHPNLIPPTSPFSQIPTTRQPGSHNFNPGGANHSRSMSQPNSFFSFDSLPPLSPSPFRDHDVSMEDRDSGVFNSNHSLPPSPFTRCNSTSSSSLRVGESLPPRKSHRRSNSDIPSGFNSMPLIPPRPLERSFSGGECADWSKSNPFVKKESSCEREGVGEREAMDDLFSAYMNLENIDVLNSSEADDSKNGNENRDDMESSRASGTKTNGSDTEGESSSVNESANNNMNSSGEKRESVKRRAAGGDIAPTTRHYRSVSVDSCFMEKLSFGDESLKPPPSPGSMSRKVSPTNSVDGNSGAAFSIEFNNGEFTAAEMKKIMANDKLAEMAMSDPKRVKRNDPLFRILANRQSAARSKERKMRYIVELEHKVQTLQTEATTLSAQLTLLQRDMMGLTNQNNELKFRLQAMEQQARLRDALNEALNGEVQRLKLAIGESSQNESERSKMQSLNAEMFQQLNISQLRQQPQQMQQQSHQQNHQNGTMATKSESNE

SEQ ID NO: 2727 - DNA, 1087 bp, Arabidopsis thaliana
  G1811
aaaggagcattggtatctcaaacaatatttgccctttctctatctctctctcatcactatttgccatctctttctctctccctctctttcaaatgtcaataaaccaatactcaagcgatttccactaccattctctcatgtggcaacaacagcagcaacaacaacaacaccaaaacgacgtcgtggaagaaaaagaagctcttttcgagaaacccttaaccccaagtgacgtcggaaaactcaaccgcctcgtcatcccaaaacagcacgccgagagatacttcccactagcggccgccgccgcagacgccgtggagaaaggacttctcctctgctttgaggacgaggaaggtaaaccatggagattcagatactcgtactggaacagtagccagagttatgtcttgaccaaaggctggagcagatacgtcaaggagaagcaccttgacgccggagacgtcgttctcttccatcgacaccgttcagacggcggaagattcttcattggctggagaagacgcggtgactcttcttcctcctccgactcttatcgccatgttcaatccaatgcctcgctccaatattatcctcatgcaggggctcaagcggtggagagccaaagaggcaactcgaagacattaagactgttcggagtgaacatggagtgccagctagattcggactggtccgagccatccacacctgacggttctaacacatatacaaccaatcacgaccagtttcatttctaccctcaacaacaacactatcctcctccgtactacatggacataagtttcacaggagatatgaaccggacgagctagaagcccacaaggattaaaaaaaagcttcacatctggtcctgttatgttgtcatagatgttgattccttaattttacacaagcttcattttgcattatttaaagtaaaatcgtattttgattcttctttaaatctctctcaattttcactctcttcctttttcttcttatgtattagattcttttacatagctaacacttgtatagagaattcaaagttctggctattttcgaaagttatcttttctcttaaaaaaaaaaa

SEQ ID NO: 2728 - protein, 244 aa, Arabidopsis thaliana
  G1811
MSINQYSSDFHYHSLMWQQQQQQQQHQNDVVEEKEALFEKPLTPSDVGKLNRLVIPKQHAERYFPLAAAAADAVEKGLLLCFEDEEGKPWRFRYSYWNSSQSYVLTKGWSRYVKEKHLDAGDVVLFHRHRSDGGRFFIGWRRRGDSSSSSDSYRHVQSNASLQYYPHAGAQAVESQRGNSKTLRLFGVNMECQLDSDWSEPSTPDGSNTYTTNHDQFHFYPQQQHYPPPYYMDISFTGDMNRTS

SEQ ID NO: 2729 - DNA, 1308 bp, Arabidopsis thaliana
  G1817
atgaaggacgcagagaagcgagaggtgattgcatcatcatcattacaaagaaagagaaacagaggaagaagactaaggaaaagaagaagaagaaacgagaagcgagtactaatggttccatcatcattaccaaacgacgtgctagaggagatctttttaagatttccggttaaagccctaatccgactcaagtctctctcgaaacaatggagatcgacgatcgaatctcgcagttttgaagagagacacttgacgatcgctaagaaagccttcgtggatcatcccaaggtcatgctcgtaggagaagaagatcccataagaggaaccgggattcgtccagacactgacattggttttaggttattctgcttggaatcggcttctcttctatcctttactcgtctcaatttccctcaagggttcttcaactggatctacatatctgaaagctgtgatggccttttctgcatccattccccaaaatcacattccgtatatgtagtgaatccggctacacggtggctccgcctacttcctccggcagggtttcagattttgatccacaagtttaaccccactgaacgtgagtggaatgtagtgatgaaatcaatctttcatctagcattcgtgaaggccaccgattacaaattagtgtggttgtacaattgtgataagtacattgttgatgcgtcgagtccaaacgtgggagtcacaaagtgcgagatttttgactttaggaaaaatgcttggaggtacttggcttgcactccaagtcatcagatattctattaccaaaagccagcatctgcaaacgggtcggtttattggtttacagaaccatataatgaaagaatcgaagtagtggcttttgatattcagaccgaaacattccggttgctgcctaagattaatccggctattgctggttcagatcctcaccatattgacatgtgcactctggataatagtttgtgtatgtcgaaaagggagaaagatactatgatccaagatatttggaggttgaaaccatcagaagacacatgggaaaagatttttagcatagacttggtttcctgtccttcttctcggactgagaagcgtgatcaatttgattggagcaagaaggatagggttgagccagccacacccgtcgcggtttgtaagaataagaagatccttctctcacatcgctattcccgaggtttggtaaagtacgatcccctaacaaaatctatcgattttttttccggacatcctaccgcttacagaaaagttatttattttcaaagtttgatatctcatctataa

SEQ ID NO: 2730 - protein, 435 aa, Arabidopsis thaliana
  G1817
MKDAEKREVIASSSLQRKRNRGRRLRKRRRRNEKRVLMVPSSLPNDVLEEIFLRFPVKALIRLKSLSKQWRSTIESRSFEERHLTIAKKAFVDHPKVMLVGEEDPIRGTGIRPDTDIGFRLFCLESASLLSFTRLNFPQGFFNWIYISESCDGLFCIHSPKSHSVYVVNPATRWLRLLPPAGFQILIHKFNPTEREWNVVMKSIFHLAFVKATDYKLVWLYNCDKYIVDASSPNVGVTKCEIFDFRKNAWRYLACTPSHQIFYYQKPASANGSVYWFTEPYNERIEVVAFDIQTETFRLLPKINPAIAGSDPHHIDMCTLDNSLCMSKREKDTMIQDIWRLKPSEDTWEKIFSIDLVSCPSSRTEKRDQFDWSKKDRVEPATPVAVCKNKKILLSHRYSRGLVKYDPLTKSIDFFSGHPTAYRKVIYFQSLISHL

SEQ ID NO: 2731 - DNA, 639 bp, Arabidopsis thaliana
  G1819
atggaagagaacaacggcaacaacaaccactacctgccgcaaccatcgtcttcccaactgccgccgccaccattgtattatcaatcaatgccgttgccgtcatattcactgccgctgccgtactcaccgcagatgcggaattattggattgcgcagatgggaaacgcaactgatgttaagcatcatgcgtttccactaaccaggataaagaaaatcatgaagtccaacccggaagtgaacatggtcactgcagaggctccggtccttatatcgaaggcctgtgagatgctcattcttgatctcacaatgcgatcgtggcttcataccgtggagggcggtcgccaaactctcaagagatccgatacgctcacgagatccgatatctccgccgcaacgactcgtagtttcaaatttaccttccttggcgacgttgtcccaagagacccttccgtcgttaccgatgatcccgtgctacatccggacggtgaagtacttcctccgggaacggtgataggatatccggtgtttgattgtaatggtgtgtacgcgtcaccgccacagatgcaggagtggccggcggtgcctggtgacggagaggaggcagctggggaaattggaggaagcagcggcggtaattga

SEQ ID NO: 2732 - protein, 212 aa, Arabidopsis thaliana
  G1819
MEENNGNNNHYLPQPSSSQLPPPPLYYQSMPLPSYSLPLPYSPQMRNYWIAQMGNATDVKHHAFPLTRIKKIMKSNPEVNMVTAEAPVLISKACEMLILDLTMRSWLHTVEGGRQTLKRSDTLTRSDISAATTRSFKFTFLGDVVPRDPSVVTDDPVLHPDGEVLPPGTVIGYPVFDCNGVYASPPQMQEWPAVPGDGEEAAGEIGGSSGGN

SEQ ID NO: 2733 - DNA, 969 bp, Arabidopsis thaliana
  G1835
atgattggaacaagcttccccgaggatcttgattgtggcaacttctttgacaacatggatgatctcatggactttcccggtggagatatcgatgtcggtttcggcataggtgactccgactctttccctaccatctggaccactcatcacgacacgtggcctgccgcttctgatcctctcttctcttccaacaccaactctgattcatcacctgagctctatgttccgtttgaggacattgttaaggtggaaagacctccaagctttgtagaggaaacattggttgagaagaaggaagattcgttttcgacaaacactgattcatcatcttctcatagccaattcaggagctcaagtccagtgtcggttctcgagagcagctcctcctcgtctcaaaccaccaacacaacctcccttgttctccctggaaagcacggtcgtccacgcacaaaacgccctcgtccacctgtccaggataaagatagagtcaaagacaatgtgtgcggtggtgactcgcgcctcatcattagaataccgaaacagtttctctctgatcacaacaagatgatcaacaagaagaagaagaagaaggccaagattacttcttcctcttcttcgtccgggattgatcttgaagtcaatggaaacaacgtcgattcgtattcttcagagcaatatccgcttaggaaatgtatgcactgtgaggtcaccaagactccacagtggaggcttggtccaatgggtccaaagacactttgcaatgcgtgcggtgtacgttacaaatcagggaggcttttcccggagtaccgtccagctgctagtccaacatttactccagctcttcactcaaactcacacaagaaagtggctgaaatgagaaacaagagatgcagtgatggtagctacataaccgaagagaatgatctgcaagggctgattccgaacaatgcctacattggcgtagactaa

SEQ ID NO: 2734 - protein, 322 aa, Arabidopsis thaliana
  G1835
MIGTSFPEDLDCGNFFDNMDDLMDFPGGDIDVGFGIGDSDSFPTIWTTHHDTWPAASDPLFSSNTNSDSSPELYVPFEDIVKVERPPSFVEETLVEKKEDSFSTNTDSSSSHSQFRSSSPVSVLESSSSSSQTTNTTSLVLPGKHGRPRTKRPRPPVQDKDRVKDNVCGGDSRLIIRIPKQFLSDHNKMINKKKKKKAKITSSSSSSGIDLEVNGNNVDSYSSEQYPLRKCMHCEVTKTPQWRLGPMGPKTLCNACGVRYKSGRLFPEYRPAASPTFTPALHSNSHKKVAEMRNKRCSDGSYITEENDLQGLIPNNAYIGVD

SEQ ID NO: 2735 - DNA, 1226 bp, Arabidopsis thaliana
  G1845
aagacataattttctctgttttcctagctctctcctctcaaattcttccattgctctctgttttggcaaatcgtgaactgccacgtctttaaggcatcagtgaagcaaagatggactttgacgaggagctaaatctttgtattacgaaaggtaaaaatgttgatcattcttttggaggagaagcttcttccacgtccccaagatctatgaagaaaatgaagagtcctagtcgtcctaaaccctatttccaatcctcttcttctccttattcgttagaggctttccctttttctctcgatccaacacttcagaatcagcaacaacaactcggatcatacgttccggtacttgagcaacgacaagacccgacaatgcaaggccagaagcaaatgatctcctttagtcctcaacaacaacaacagcagcagcagtatatggcccagtactggagtgacacattgaatctgagtccaagaggaagaatgatgatgatgatgagccaagaagctgttcaaccttacatcgcaacgaagctgtacagaggagtgagacaacgtcaatggggaaaatgggtcgcagagatccgtaagccacgaagcagggcacgtctttggcttggtacctttgatacagctgaagaagctgccatggcctacgaccgccaagccttcaaattacgaggccacagcgcaacactgaatttcccggagcattttgtgaataaggaaagcgagctgcatgattcaaactcgtcggatcagaaagaacctgaaacgccacagccaagcgaggttaacttggagagcaaggaactaccggtgattgatgttgggagagaggaaggtatggctgaggcatggtacaatgccattacatcgggatggggtcctgaaagtcctctttgggatgatttggatagttctcatcagttttcatcagaaagctcatcttcttctcctctctcttgtcctatgaggcctttcttttgaaaaagtttataaacccacattgtgttgtaggttatagtttagggttatgctcattggcatttggatggaggcaatttttgtgatctcccattccaccacatatcagtcattatatgtgtctaccttttctctgtatttctatcattatcattgtttttattatgtgtctgtatgtgtttccctattgctacatacatagatgtcctctttgttcaaaaaaaaaaaaaaaaaaaaaaa

SEQ ID NO: 2736 - protein, 292 aa, Arabidopsis thaliana
  G1845
MDFDEELNLCITKGKNVDHSFGGEASSTSPRSMKKMKSPSRPKPYFQSSSSPYSLEAFPFSLDPTLQNQQQQLGSYVPVLEQRQDPTMQGQKQMISFSPQQQQQQQQYMAQYWSDTLNLSPRGRMMMMMSQEAVQPYIATKLYRGVRQRQWGKWVAEIRKPRSRARLWLGTFDTAEEAAMAYDRQAFKLRGHSATLNFPEHFVNKESELHDSNSSDQKEPETPQPSEVNLESKELPVIDVGREEGMAEAWYNAITSGWGPESPLWDDLDSSHQFSSESSSSSPLSCPMRPFF

SEQ ID NO: 2737 - DNA, 1860 bp, Arabidopsis thaliana
  G1853
atgagaggttcttggtacaagagtgtttcctctgtttttggtctcagaccacggatcagagggttgttattcttcattgttggtgttgtggctctagttactattttagcaccattgacatctaattcgtatgattcttcgtcaagttcgacacttgtgccgaacatttatagtaactataggaggataaaggagcaagctgctgttgattatcttgatctgaggtctctttctttaggggctagtttaaaagagtttcctttttgtggtaaagaaagagaaagttatgtgccttgttataacataactgggaatttgcttgctgggcttcaagagggtgaggagttagatcgacattgcgagtttgaaagagagaaggaaagatgtgtagttcgtcctccgagagattataaaataccacttaggtggccacttggtagagatatcatatggagtgggaacgtgaagattaccaaagaccagtttctttcttcaggaactgtgacaacgaggttaatgttgcttgaagagaatcaaataacctttcactcggaggacggcctggtctttgatggggtcaaagactatgctcgtcaaattgctgagatgataggtttaggaagtgatactgaatttgctcaagcgggtgtacggactgtgttagacattggttgcggatttggtagctttggtgctcatttagtgtctttgaagctgatgcctatatgtattgctgagtatgaggcaactgggagccaagttcagttagctctagagagaggccttcctgcaatgattggcaatttcttttcaaaacagcttccttatccagcactgtcttttgatatggtccattgtgctcaatgtggcactacttgggatatcaaagatgcaatgctacttttggaagtggatcgtgttctgaaacccgggggatactttgttttaacttctcccacaaacaaagcacagggaaacttaccagataccaagaaaacgagcatctcaacacgggtgaatgagttatctaagaaaatctgttggagtctaacagctcagcaggatgagacgtttctttggcagaaaacttctgattcaagttgctattcttctcgttcgcaagcttctatacctctttgcaaagatggagatagcgttccgtattaccacccattggttccatgtataagcggaaccacgagtaaacgctggatttctatacagaacaggtctgctgttgcaggaacaacctctgccgggcttgaaattcatggtttaaaaccggaagaattcttcgaggatacacaaatatggagatcagctctgaaaaactattggtccttgcttacacctctaattttctctgaccatccgaagagacccggtgatgaggatcctctcccgcctttcaacatgatacgcaatgtgatggacatgcatgctcgttttgggaatttaaatgccgctttactcgacgaaggaaaatctgcttgggtaatgaacgtcgtcccagtcaatgcacgtaatactcttcctatcatacttgatcgtggtttcgccggtgttctacatgactggtgtgaaccattcccgacatatcctcgaacatatgacatgcttcatgccaatgaacttctcacacatcttagctcagaacgatgcagcctaatggacttgttcttggagatggaccggattcttcgccctgagggatgggttgttctaagcgacaaagtgggagtaatcgagatggctcgagcacttgcagctcgagtgcgttgggaagcaagagtcattgatcttcaagatggtagtgaccaaagacttctcgtctgtcaaaaaccattcatcaaaaaataa

SEQ ID NO: 2738 - protein, 619 aa, Arabidopsis thaliana
  G1853
MRGSWYKSVSSVFGLRPRIRGLLFFIVGVVALVTILAPLTSNSYDSSSSSTLVPNIYSNYRRIKEQAAVDYLDLRSLSLGASLKEFPFCGKERESYVPCYNITGNLLAGLQEGEELDRHCEFEREKERCVVRPPRDYKIPLRWPLGRDIIWSGNVKITKDQFLSSGTVTTRLMLLEENQITFHSEDGLVFDGVKDYARQIAEMIGLGSDTEFAQAGVRTVLDIGCGFGSFGAHLVSLKLMPICIAEYEATGSQVQLALERGLPAMIGNFFSKQLPYPALSFDMVHCAQCGTTWDIKDAMLLLEVDRVLKPGGYFVLTSPTNKAQGNLPDTKKTSISTRVNELSKKICWSLTAQQDETFLWQKTSDSSCYSSRSQASIPLCKDGDSVPYYHPLVPCISGTTSKRWISIQNRSAVAGTTSAGLEIHGLKPEEFFEDTQIWRSALKNYWSLLTPLIFSDHPKRPGDEDPLPPFNMIRNVMDMHARFGNLNAALLDEGKSAWVMNVVPVNARNTLPIILDRGFAGVLHDWCEPFPTYPRTYDMLHANELLTHLSSERCSLMDLFLEMDRILRPEGWVVLSDKVGVIEMARALAARVRWEARVIDLQDGSDQRLLVCQKPFIKK

SEQ ID NO: 2739 - DNA, 1902 bp, Arabidopsis thaliana
  G1855
atggcgaaagagaacagtggtcatcatcaccaaacagaagcaagaagaaagaaactaactttgattcttggtgtaagtggactctgcattttgttctatgttttaggtgcatggcaagccaataccgtcccatcttctatctcgaagctcggatgcgagacgcaatcaaacccttcttcgtcctcttcctcttcctcatcttcagagtcagctgaactagatttcaaaagccataatcagattgagttaaaggaaacaaaccaaaccattaagtactttgaaccatgtgaattatctctcagtgagtacactccttgtgaagaccgacaaagaggaagaagattcgataggaacatgatgaaatatagagaaagacattgtcctgtaaaagatgagcttctttattgtttgattcctcctccaccaaactacaagattccatttaaatggccacaaagtagagactatgcttggtatgacaatatccctcacaaggaacttagtgttgagaaagcagttcaaaactggattcaagttgaaggtgaccgctttagattccctggtggtggtactatgtttcctcgtggagctgatgcttatatcgatgatattgctaggcttattcctcttactgatggtggaatcagaacagctattgacactggatgtggtgttgcaagttttggtgcttacctcttgaagagagacattatggctgtgtcttttgctccaagagacactcatgaagctcaggtacagtttgctttagaacgcggagttcctgcgataatcgggattatgggatcaagaagacttccttatccagctagagcttttgatcttgctcattgttctcgttgtttgatcccttggtttaaaaatgatggtttgtaccttatggaggtcgaccgggttttaagaccgggcggttactggatcctctcgggaccaccgattaactggaaacagtactggagagggtgggagagaacagaggaggatttgaagaaagagcaagattcaatagaagatgtagcaaagagtctttgctggaagaaagtaactgaaaaaggtgacttatcaatttggcaaaagcctctcaatcacattgagtgtaaaaagctcaaacaaaacaataagtcacctccgatatgcagctcagataacgcggattccgcttggtacaaagacttggaaacttgtataacaccattaccagaaacaaacaatccagatgattcagcaggcggtgcactcgaggattggccagaccgagcattcgcggtacctccaagaatcatcagaggaactataccagaaatgaacgcggagaaatttagagaagacaacgaggtttggaaagagagaatagcacattacaagaagatagtccctgagctttcacatggaagattcaggaacattatggacatgaacgcttttctcggcggattcgctgcttccatgctgaaatatccctcatgggtcatgaacgttgtcccggtcgatgcagagaaacaaacgttaggtgtgatctacgaacgtggattgatagggacgtatcaagattggtgtgaaggattctcaacgtatccaagaacttatgatatgattcatgcaggaggattgttcagcttatacgaacataggtgtgatttgacgttgatattgttggagatggatcgaattttgagaccagaaggaacagttgtgttgagagataatgtggagacgttgaataaggtagagaagatagtgaagggaatgaagtggaagagtcaaattgttgatcatgagaaaggtccttttaatcctgagaagattcttgttgctgttaaaacttattggactggtcaaccttctgacaagaacaacaacaacaacaacaacaacaacaactag

SEQ ID NO: 2740 - protein, 633 aa, Arabidopsis thaliana
  G1855
MAKENSGHHHQTEARRKKLTLILGVSGLCILFYVLGAWQANTVPSSISKLGCETQSNPSSSSSSSSSSESAELDFKSHNQIELKETNQTIKYFEPCELSLSEYTPCEDRQRGRRFDRNMMKYRERHCPVKDELLYCLIPPPPNYKIPFKWPQSRDYAWYDNIPHKELSVEKAVQNWIQVEGDRFRFPGGGTMFPRGADAYIDDIARLIPLTDGGIRTAIDTGCGVASFGAYLLKRDIMAVSFAPRDTHEAQVQFALERGVPAIIGIMGSRRLPYPARAFDLAHCSRCLIPWFKNDGLYLMEVDRVLRPGGYWILSGPPINWKQYWRGWERTEEDLKKEQDSIEDVAKSLCWKKVTEKGDLSIWQKPLNHIECKKLKQNNKSPPICSSDNADSAWYKDLETCITPLPETNNPDDSAGGALEDWPDRAFAVPPRIIRGTIPEMNAEKFREDNEVWKERIAHYKKIVPELSHGRFRNIMDMNAFLGGFAASMLKYPSWVMNVVPVDAEKQTLGVIYERGLIGTYQDWCEGFSTYPRTYDMIHAGGLFSLYEHRCDLTLILLEMDRILRPEGTVVLRDNVETLNKVEKIVKGMKWKSQIVDHEKGPFNPEKILVAVKTYWTGQPSDKNNNNNNNNNN

SEQ ID NO: 2741 - DNA, 952 bp, Arabidopsis thaliana
  G1865
aagaagaggacatgaagcacagagattctgcagactgcaggtgaccaatggacactttatcaataaaaacatacctactactctcttacactttcaattttccaatacaaatcccaatctttaatctctctttcttcttcatctctctttctctttctctcttcatggctacaaggattccattcacagaatcacaatgggaagaacttgaaaaccaagctcttgtgttcaagtacttagctgcaaatatgcctgttccacctcatcttctcttcctcatcaaaagaccctttctcttctcttcttcttcttcttcatcttcttcttcaagcttcttctctcccactctttctccacactttgggtggaatgtgtatgagatgggaatgggaagaaagatagatgcagagccaggaagatgtagaagaactgatggcaagaaatggagatgctctaaagaagcttaccctgactctaagtactgtgagagacatatgcatagaggcaagaaccgttcttcctcaagaaagcctcctcctactcaattcactccaaatctctttctcgactcttcttccagaagaagaagaagtggatacatggatgatttcttctccatagaaccttccgggtcaatcaaaagctgctctggctcagcaatggaagataatgatgatggctcatgtagaggcatcaacaacgaggagaagcagccggatcgacattgcttcatccttggtactgacttgaggacacgtgagaggccattgatgttagaggagaagctgaaacaaagagatcatgataatgaagaagagcaaggaagcaagaggttttataggtttcttgatgaatggccttcttctaaatcttctgtttctacttcactcttcatttgatcatcttttgttcttataaccttgtatttcttgttaagatggtaatgcaaatt

SEQ ID NO: 2742 - protein, 283 aa, Arabidopsis thaliana
  G1865
MDTLSIKTYLLLSYTFNFPIQIPIFNLSFFFISLSLSLFMATRIPFTESQWEELENQALVFKYLAANMPVPPHLLFLIKRPFLFSSSSSSSSSSSFFSPTLSPHFGWNVYEMGMGRKIDAEPGRCRRTDGKKWRCSKEAYPDSKYCERHMHRGKNRSSSRKPPPTQFTPNLFLDSSSRRRRSGYMDDFFSIEPSGSIKSCSGSAMEDNDDGSCRGINNEEKQPDRHCFILGTDLRTRERPLMLEEKLKQRDHDNEEEQGSKRFYRFLDEWPSSKSSVSTSLFI

SEQ ID NO: 2743 - DNA, 1107 bp, Arabidopsis thaliana
  G1879
aaatgcccttagaggctgtcgtatacccgcaagatccattcggatatctctccaattgcaaagattttatgttccacgacttatactctcaagaagagttcgtagctcaagatacgaagaacaacattgataagttagggcatgaacagagctttgtggaacaaggtaaggaggacgatcatcaatggcgagactatcatcagtatcctttgttgatcccttcgttgggagaagagcttggtcttaccgccattgatgtggagagtcatcctcctccacagcaccggaggaagaggaggagaacgagaaactgcaagaacaaggaagagatcgagaaccagagaatgactcacatcgccgtcgagagaaatcgccggaaacagatgaacgagtatctggctgtgctccgttctctaatgccgtcgtcgtatgctcaaagaggagatcaagcgtcgatagtaggaggagctataaactacgtgaaggagttagagcatattttacaatctatggagccgaagagaactaggactcatgatcccaaaggagacaagactagcactagctcgttagtgggtccattcacagattttttcagcttcccacaatattctacaaagtcatcatcagatgtaccggaaagctcatcttcaccggcggagatagaggttacggtggcagaaagccatgcgaacatcaagataatgacgaagaagaaaccgaggcagcttcttaagctcataacttctttacaaagcctaaggctcactcttcttcatctcaatgtcaccactctccacaactccattctctactccatcagcgtcagggttgaagaaggaagccaactgaataccgtggacgacattgcaacagctttgaatcaaaccataaggaggattcaagaagagacataattcagcaaatagattataattaacttgttttatttttattttattttgaaataactgaaatcagttttctaattttttttttttttcactattcctctaatcctccctatgtaagttgcatttttgtctcttgtaatgaatcaatggtcataaagatctgaacaaaaaaattgaataaaagaaaatggtt

SEQ ID NO: 2744 - protein, 304 aa, Arabidopsis thaliana
  G1879
MPLEAVVYPQDPFGYLSNCKDFMFHDLYSQEEFVAQDTKNNIDKLGHEQSFVEQGKEDDHQWRDYHQYPLLIPSLGEELGLTAIDVESHPPPQHRRKRRRTRNCKNKEEIENQRMTHIAVERNRRKQMNEYLAVLRSLMPSSYAQRGDQASIVGGAINYVKELEHILQSMEPKRTRTHDPKGDKTSTSSLVGPFTDFFSFPQYSTKSSSDVPESSSSPAEIEVTVAESHANIKIMTKKKPRQLLKLITSLQSLRLTLLHLNVTTLHNSILYSISVRVEEGSQLNTVDDIATALNQTIRRIQEET

SEQ ID NO: 2745 - DNA, 519 bp, Arabidopsis thaliana
  G1881
atgcgaattttgtgtgatgcttgtgagagcgccgccgctatcgtcttttgcgccgccgacgaagctgccctctgttgctcctgcgacgaaaaagttcataagtgcaacaagctggctagtcggcatcttcgtgtaggcttagctgatccgagtaatgcaccaagctgtgacatatgcgaaaatgcacccgcattcttttactgtgagatagatggtagttccctttgtctacaatgtgatatggtggtacatgttggtgggaagagaacacataggcggtttctattactgagacagagaattgagtttccaggcgataagcctaatcatgctgaccaactgggactacggtgtcaaaaggcttcctctggtcgtggtcaagaatcaaatgggaatggtgatcatgatcataatatgatcgatcttaactccaatcctcaaagagtacacgagcctggatcacataaccaagaggagggtattgatgtaaataacgcaaacaatcacgagcatgaatag

SEQ ID NO: 2746 - protein, 172 aa, Arabidopsis thaliana
  G1881
MRILCDACESAAAIVFCAADEAALCCSCDEKVHKCNKLASRHLRVGLADPSNAPSCDICENAPAFFYCEIDGSSLCLQCDMVVHVGGKRTHRRFLLLRQRIEFPGDKPNHADQLGLRCQKASSGRGQESNGNGDHDHNMIDLNSNPQRVHEPGSHNQEEGIDVNNANNHEHE

SEQ ID NO: 2747 - DNA, 1200 bp, Arabidopsis thaliana
  G1882
atggttttttcttcatttcctacttatcctgatcattcatcaaactggcaacaacaacatcaaccaatcacaaccaccgttggattcacgggaaataacatcaaccaacagtttcttcctcaccatcccctcccaccgcaacagcaacaaacgcctccgcagcttcaccacaacaacggtaacggcggagtcgctgttcccggtggacctggcgggttaatccgaccaggttcgatggcggaaagagcaaggctagccaacataccattacctgaaacagccttgaagtgtccaagatgtgactcaactaacaccaaattctgttacttcaacaactacagtctcactcaacctcgccacttctgcaaagcatgccgtcgttactggacacgtggcggtgctctaaggagcgttcccgtcggtggcggttgccgtagaaacaaaagaaccaaaaacagcagcggtggaggtggcggtagcaccagtagcggtaacagcaagtcacaagacagcgccacgagcaacgaccaataccaccaccgagccatggctaacaatcagatgggaccaccttcttcgtcatcgtctctaagctcgttgctgtcttcttacaacgcagggttaatccccggacatgatcataacagcaataacaacaacatacttggacttggatcatctttgcctcctcttaagcttatgcctcctttagacttcacagacaacttcaccttacaatacggtgccgtttcagctccttcttatcatataggcggtggaagcagtggaggagcggcggctcttttaaacggttttgaccagtggagattcccggcaacaaaccaacttcctttaggcggtttagacccgtttgatcaacaacatcaaatggagcagcagaatccaggttacggattggttaccgggtcgggtcagtatcgacctaagaacattttccataaccttatctcctcttcttcgtctgcttcatcagctatggttacagccaccgcgtcgcaattagcttcagtgaaaatggaagatagtaacaatcagctcaacttgtctagacaactttttggagacgaacaacagctctggaatattcatggcgctgctgcagcatccaccgcagctgcaacaagttcgtggagtgaagtctctaataatttcagttcttcttctactagcaatatataa

SEQ ID NO: 2748 - protein, 399 aa, Arabidopsis thaliana
  G1882
MVFSSFPTYPDHSSNWQQQHQPITTTVGFTGNNINQQFLPHHPLPPQQQQTPPQLHHNNGNGGVAVPGGPGGLIRPGSMAERARLANIPLPETALKCPRCDSTNTKFCYFNNYSLTQPRHFCKACRRYWTRGGALRSVPVGGGCRRNKRTKNSSGGGGGSTSSGNSKSQDSATSNDQYHHRAMANNQMGPPSSSSSLSSLLSSYNAGLIPGHDHNSNNNNILGLGSSLPPLKLMPPLDFTDNFTLQYGAVSAPSYHIGGGSSGGAAALLNGFDQWRFPATNQLPLGGLDPFDQQHQMEQQNPGYGLVTGSGQYRPKNIFHNLISSSSSASSAMVTATASQLASVKMEDSNNQLNLSRQLFGDEQQLWNIHGAAAASTAAATSSWSEVSNNFSSSSTSNI

SEQ ID NO: 2749 - DNA, 1110 bp, Arabidopsis thaliana
  G1883
atggacgctacgaagtggacacagggttttcaagaaatgatgaacgttaaaccaatggagcagatcatgattcctaataacaacacacatcaaccaaacaccacatccaatgcaaggccaaacaccattctcacatctaacggcgtctcaactgctggagcaaccgtctccggcgtaagcaacaacaataacaatacggcggttgtggcggagaggaaagcaagaccacaagagaaactaaattgtccaagatgcaactcaaccaacacaaagttttgttactacaacaactatagtctcacacaaccaagatacttctgcaaaggttgtcgaaggtattggaccgaaggtggatctcttaggaatgttcctgtgggaggaagctcaagaaagaacaagagatcatcttcatcttcttcatcaaacatccttcagacaataccatcttcacttccagatctaaacccgccaatactcttctcaaaccaaatccataataaatcgaaagggtcatcacaagatctcaacttgttgtctttcccagtcatgcaagatcaacatcatcatcatgtccatatgtctcagtttcttcagatgcctaagatggagggaaatggtaacataactcatcagcagcagccttcatcatcttcttctgtctatggttcctcgtcgtctcctgtttcagctcttgaacttttaagaaccggagttaatgtttcttcaagatcagggattaactcatcgttcatgccttccggttcaatgatggattcaaacactgtgctttacacttcttcagggtttccaacaatggtggattacaagccaagtaatctctccttctctaccgatcatcaagggcttggacacaatagcaacaataggtctgaagctcttcatagtgatcatcaccaacaaggtagagttttgtttccatttggggatcaaatgaaggagctttcatcaagcataacacaagaagttgatcatgatgataatcaacaacagaagagtcatggaaataataataataataataactcaagccctaataatggatattggagtgggatgttcagtactacaggaggaggatcttcatggtga

SEQ ID NO: 2750 - protein, 369 aa, Arabidopsis thaliana
  G1883
MDATKWTQGFQEMMNVKPMEQIMIPNNNTHQPNTTSNARPNTILTSNGVSTAGATVSGVSNNNNNTAVVAERKARPQEKLNCPRCNSTNTKFCYYNNYSLTQPRYFCKGCRRYWTEGGSLRNVPVGGSSRKNKRSSSSSSSNILQTIPSSLPDLNPPILFSNQIHNKSKGSSQDLNLLSFPVMQDQHHHHVHMSQFLQMPKMEGNGNITHQQQPSSSSSVYGSSSSPVSALELLRTGVNVSSRSGINSSFMPSGSMMDSNTVLYTSSGFPTMVDYKPSNLSFSTDHQGLGHNSNNRSEALHSDHHQQGRVLFPFGDQMKELSSSITQEVDHDDNQQQKSHGNNNNNNNSSPNNGYWSGMFSTTGGGSSW

SEQ ID NO: 2751 - DNA, 741 bp, Arabidopsis thaliana
  G1884
atgatgacgtcatcccatcagagcaacaccaccggctttaaaccgcggcggatcaagacgacggcgaagccaccacgtcagatcaataacaaagaaccatctccggcgacgcagccggtgctcaagtgtccgagatgtgattcagtcaacaccaaattctgctactacaacaactacagcttgtctcagccacgtcactactgcaagaactgtcgtcgttactggacacgtggcggcgccctccgtaacgttcccatcggtggctccactcgaaacaagaacaagccttgcagcctccaagtcatctcttctcctcctttgttctcgaacgggacgtcatcggcgtctcgtgagcttgtaagaaaccatccatcgacggcaatgatgatgatgagttctggtggattctccggctatatgtttccgttggatcctaacttcaaccttgcctcgtcttctatcgagtctttgagttcttttaaccaagatttgcaccagaagcttcagcaacaaagactcgtcacttccatgtttctccaagattctcttccggttaacgagaaaacggttatgtttcagaacgtagagttgattcctccttcgacggtgacgacggattgggttttcgataggttcgccactggaggaggtgcaacaagtggcaatcatgaagataatgatgatggggagggtaatttgggaaattggttccataatgctaataataatgctctgctctaa

SEQ ID NO: 2752 - protein, 246 aa, Arabidopsis thaliana
  G1884
MMTSSHQSNTTGFKPRRIKTTAKPPRQINNKEPSPATQPVLKCPRCDSVNTKFCYYNNYSLSQPRHYCKNCRRYWTRGGALRNVPIGGSTRNKNKPCSLQVISSPPLFSNGTSSASRELVRNHPSTAMMMMSSGGFSGYMFPLDPNFNLASSSIESLSSFNQDLHQKLQQQRLVTSMFLQDSLPVNEKTVMFQNVELIPPSTVTTDWVFDRFATGGGATSGNHEDNDDGEGNLGNWFHNANNNALL

SEQ ID NO: 2753 - DNA, 920 bp, Arabidopsis thaliana
  G1886
aggaaacataagtaatcgttgcttcgatcctttgttacatggatggatcctgaacaggaaatctcaaacgagactttggaaactatattggtaagttcaacaaaaggaagcaataataacaataagaaaatggaagaagaaatgaagaagaaagtatcaagaggagaattaggaggtgaagctcaaaattgtccaagatgtgaatctccaaacacaaagttttgttactacaacaactatagtctctcacaacctcgttacttctgcaaatcttgtcggagatattggactaaaggcggtactcttcgtaacgttcccgtcggtggtggttgccgtcgaaacaaacgatcctcttcctcagctttctccaagaacaacaacaataagtctattaatttccatactgatccacttcagaaccctttaattacgggaatgccaccatcatcttttggttatgatcactccattgatctcaacctcgctttcgctactctccaaaagcatcatttatcctctcaagctactacgccttcttttgggtttggaggtgatctttctatttatggaaactcaacgaatgatgtagggatcttcggagggcaaaacggtacttataacaatagtttgtgttatgggtttatgtccggaaatggtaataataatcaaaatgaaatcaagatggcttctacattggggatgtctttggaaggaaacgagagaaagcaagagaatgtgaacaataacaataataactcagagaatcctagcaaggtgttctgggggtttccatggcagatgaccggagattccgccggagttgtaccggagattgatcccggaagggaaagctggaatgggatggtttcatcttggaataatggtttactcaacactcctttggtctagcagatcattaa

SEQ ID NO: 2754 - protein, 288 aa, Arabidopsis thaliana
  G1886
MDPEQEISNETLETILVSSTKGSNNNNKKMEEEMKKKVSRGELGGEAQNCPRCESPNTKFCYYNNYSLSQPRYFCKSCRRYWTKGGTLRNVPVGGGCRRNKRSSSSAFSKNNNNKSINFHTDPLQNPLITGMPPSSFGYDHSIDLNLAFATLQKHHLSSQATTPSFGFGGDLSIYGNSTNDVGIFGGQNGTYNNSLCYGFMSGNGNNNQNEIKMASTLGMSLEGNERKQENVNNNNNNSENPSKVFWGFPWQMTGDSAGVVPEIDPGRESWNGMVSSWNNGLLNTPLV

SEQ ID NO: 2755 - DNA, 750 bp, Arabidopsis thaliana
  G1891
atggataacttgaatgttttcgcaaatgaagacaatcaagtgaatgatgtgaagcccccaccaccaccacctcgagtgtgtgcaaggtgtgattctgataatactaaattttgttattacaacaactactgtgagtttcagccacgatacttctgcaagaactgtcgtagatactggactcatggtggggctttaagaaacataccaattggtggaagtagtcgtgccaaacgggcaagggtaaatcaaccttcggttgctcggatggtttctgttgagacccaacgaggtaacaatcaacctttctctaatgttcaagaaaacgttcatcttgttggatcttttggtgcttcatcttcatcttctgttggtgctgttgggaacctttttggttctttgtatgatattcatggtggtatggtaacaaatttgcatccaactcgaactgttcgaccaaatcatcgcttagctttccatgatggatcatttgagcaagactattacgatgttgggtccgataatcttttggtcaaccaacaagttggtggctacggttatcacatgaatccagtggatcaattcaagtggaaccagagcttcaacaacactatgaacatgaattataataacgatagcactagtggaagtagcagaggatctgacatgaatgtgaaccatgataacaagaagatcagataccgcaactctgtgattatgcatccttgtcatctggagaaggatggtccttga

SEQ ID NO: 2756 - protein, 249 aa, Arabidopsis thaliana
  G1891
MDNLNVFANEDNQVNDVKPPPPPPRVCARCDSDNTKFCYYNNYCEFQPRYFCKNCRRYWTHGGALRNIPIGGSSRAKRARVNQPSVARMVSVETQRGNNQPFSNVQENVHLVGSFGASSSSSVGAVGNLFGSLYDIHGGMVTNLHPTRTVRPNHRLAFHDGSFEQDYYDVGSDNLLVNQQVGGYGYHMNPVDQFKWNQSFNNTMNMNYNNDSTSGSSRGSDMNVNHDNKKIRYRNSVIMHPCHLEKDGP

SEQ ID NO: 2757 - DNA, 951 bp, Arabidopsis thaliana
  G1896
atgtcctcccataccaatctcccctctcccaaaccagttcctaaaccagatcaccgtatctccggtacatcccaaaccaagaaaccaccgtcttcctccgtagctcaagaccaacaaaacctaaaatgccctcgttgcaactctccaaacacaaagttctgttactacaacaactacagtctctctcaacctcgtcacttctgcaaatcttgtcgccgttactggacacgtggcggtgctctaagaaacgtccccatcggtggtggttgccggaaaaccaaaaaatctatcaaacctaattcctccatgaacacacttccttcgtcttcttcctctcagaggttcttctcatcaatcatggaagattcatccaaattcttccctcctccgacaacaatggattttcagctggccggattatctctcaacaaaatgaacgatcttcaacttttgaataaccaagaagttcttgatcttaggcccatgatgtcctcgggccgagaaaacacacccgttgatgtcgggtcgggtttatccctaatgggttttggagatttcaacaacaaccattcaccgacggggttcacaaccgccggagcaagcgacggaaacttagcttcttctatagagactttgagttgtttaaaccaagatttacactggaggcttcagcaacagaggatggcgatgctttttggtaattctaaggaagaaactgttgtcgtcgagaggccacaacctattctttatcggaatcttgagatcgtaaactcatcatcgccgtcgtcgccgacgaagaaaggagataatcagacagagtggtattttggtaataacagtgataatgaaggagtgattagtaataatgctaatacaggaggaggaggaagtgaatggaacaatggaattcaagcttggactgatcttaatcattataatgcattgccttga

SEQ ID NO: 2758 - protein, 316 aa, Arabidopsis thaliana
  G1896
MSSHTNLPSPKPVPKPDHRISGTSQTKKPPSSSVAQDQQNLKCPRCNSPNTKFCYYNNYSLSQPRHFCKSCRRYWTRGGALRNVPIGGGCRKTKKSIKPNSSMNTLPSSSSSQRFFSSIMEDSSKFFPPPTTMDFQLAGLSLNKMNDLQLLNNQEVLDLRPMMSSGRENTPVDVGSGLSLMGFGDFNNNHSPTGFTTAGASDGNLASSIETLSCLNQDLHWRLQQQRMAMLFGNSKEETVVVERPQPILYRNLEIVNSSSPSSPTKKGDNQTEWYFGNNSDNEGVISNNANTGGGGSEWNNGIQAWTDLNHYNALP

SEQ ID NO: 2759 - DNA, 678 bp, Arabidopsis thaliana
  G1897
atgccttctgaattcagtgaatctcgtcgggttcctaagattccccacggccaaggaggatctgttgcgattccgacggatcaacaagagcagctttcttgtcctcgctgtgaatcaaccaacaccaagttctgttactacaacaactacaacttctcacaacctcgtcatttctgcaagtcttgtcgccgttactggactcatggaggtactctccgtgacattcccgtcggtggtgtttcccgtaaaagctcaaaacgttcccggacttattcctctgccgctaccacctccgttgtcggaagccggaactttcccttacaagctacgcctgttcttttccctcagtcgtcttccaacggcggtatcacgacggcgaagggaagtgcttcgtcgttctatggcggtttcagctctttgatcaactacaacgccgccgtgagcagaaatgggcctggtggcgggtttaatgggccagatgcttttggtcttgggcttggtcacgggtcgtattatgaggacgtcagatatgggcaaggaataacggtctggccgttttcaagtggcgctactgatgctgcaactactacaagccacattgctcaaatacccgccacgtggcagtttgaaggtcaagagagcaaagtcgggttcgtgtctggagactacgtagcgtga

SEQ ID NO: 2760 - protein, 225 aa, Arabidopsis thaliana
  G1897
MPSEFSESRRVPKIPHGQGGSVAIPTDQQEQLSCPRCESTNTKFCYYNNYNFSQPRHFCKSCRRYWTHGGTLRDIPVGGVSRKSSKRSRTYSSAATTSVVGSRNFPLQATPVLFPQSSSNGGITTAKGSASSFYGGFSSLINYNAAVSRNGPGGGFNGPDAFGLGLGHGSYYEDVRYGQGITVWPFSSGATDAATTTSHIAQIPATWQFEGQESKVGFVSGDYVA

SEQ ID NO: 2761 - DNA, 630 bp, Arabidopsis thaliana
  G1898
atgccgtcggaaccaaaccaaacccgacccaccagagttcagccctcaacggcggcttacccaccgccaaatctggctgagcctcttccttgtcctcgctgcaactccaccaccaccaagttctgttactacaacaactataacctcgctcagcctcgctactactgcaaatcttgccgccgttactggactcaaggtggtacactccgtgacgtccccgtcggtggtggaactcgtcgaagctcctcaaaacgtcaccgttctttctccaccactgccacctcctcttcctcctcttcttccgtcatcaccaccacgacacaagaaccagccacgactgaagcgagtcaaactaaggttactaatttaatttcaggtcatggaagctttgcttctctgttaggtttaggaagtggaaatggtgggttggattacgggtttgggtacgggtacgggcttgaggagatgagtattgggtatcttggagattcttccgtaggagagattccggtggttgatggttgtggtggtgacacgtggcagattggggagattgaaggtaaaagtggaggagacagtttgatatggcctggtcttgagatctcaatgcaaaccaacgatgttaagtga

SEQ ID NO: 2762 - protein, 209 aa, Arabidopsis thaliana
  G1898
MPSEPNQTRPTRVQPSTAAYPPPNLAEPLPCPRCNSTTTKFCYYNNYNLAQPRYYCKSCRRYWTQGGTLRDVPVGGGTRRSSSKRHRSFSTTATSSSSSSSVITTTTQEPATTEASQTKVTNLISGHGSFASLLGLGSGNGGLDYGFGYGYGLEEMSIGYLGDSSVGEIPVVDGCGGDTWQIGEIEGKSGGDSLIWPGLEISMQTNDVK

SEQ ID NO: 2763 - DNA, 897 bp, Arabidopsis thaliana
  G1900
atgctggaaactaaagatcctgcgataaagctctttggtatgaaaattcctttcccgacggttttagaggttgctgatgaagaagaagaaaagaaccaaaacaagacattaactgatcaatcggagaaagacaaaaccctaaagaaaccaaccaagattcttccatgtccaagatgcaacagcatggagactaagttctgttactacaacaactacaacgtaaaccaacctcgccatttttgtaaagcttgtcagagatattggacctcaggtgggaccatgagaagtgttccaatcggagcaggacggcgcaagaacaagaacaactcaccaacttcacattaccaccatgtgactatctccgaaacaaatggtccggtccttagtttcagcctcggagatgatcaaaaggtctcgagtaataggtttggtaatcaaaagctagttgctaggatagagaacaatgacgagcgctctaataacaacacttcgaacggtttgaattgttttccgggagtttcgtggccgtacacgtggaatcctgcgttttacccggtttacccttattggagcatgccagtgttgtcttctccggtaagttcaagtcctacttctactcttggtaagcattcgagagacgaagacgagacggtgaagcaaaaacagaggaatggatctgtattggttccaaagactttgagaattgatgatcctaatgaagctgcaaagagttcgatatggacaacacttgggatcaagaacgaagttatgttcaatgggtttggttcgaagaaagaggttaagctcagtaacaaagaagaaacagagacctcacttgttctttgtgcaaaccctgctgcgttatcaagatcaatcaatttccatgagcagatgtga

SEQ ID NO: 2764 - protein, 298 aa, Arabidopsis thaliana
  G1900
MLETKDPAIKLFGMKIPFPTVLEVADEEEEKNQNKTLTDQSEKDKTLKKPTKILPCPRCNSMETKFCYYNNYNVNQPRHFCKACQRYWTSGGTMRSVPIGAGRRKNKNNSPTSHYHHVTISETNGPVLSFSLGDDQKVSSNRFGNQKLVARIENNDERSNNNTSNGLNCFPGVSWPYTWNPAFYPVYPYWSMPVLSSPVSSSPTSTLGKHSRDEDETVKQKQRNGSVLVPKTLRIDDPNEAAKSSIWTTLGIKNEVMFNGFGSKKEVKLSNKEETETSLVLCANPAALSRSINFHEQM

SEQ ID NO: 2765 - DNA, 924 bp, Arabidopsis thaliana
  G1904
atgcaagatattcatgatttctccatgaacggagttggtggtgggggaggaggaggagggaggtttttcggtggaggaatcggcggcggaggaggtggtgatcgaaggatgagagctcatcagaacaatatacttaaccatcatcaatctctcaagtgtcctcgttgtaattctcttaacacaaagttctgttactacaacaattacaatctttctcagcctcgtcacttttgcaagaactgtcgtcgttactggactaaaggtggtgttctccgtaacgttcccgtcggaggtggttgccggaaagctaaacgttcgaaaacaaaacaggttccgtcgtcgtcatcagccgacaaaccaacgacgacgcaagatgatcatcacgtggaggagaaatcgagtacaggatctcactctagcagcgagagctcttctctcaccgcttctaactctaccaccgtcgccgccgtctccgtcaccgcggcggcggaagttgcttcgtcggttattccaggttttgatatgcctaatatgaaaatttacggtaacgggatcgagtggtcgacgttacttggacaaggctcatcggccggtggtgttttctcggagatcggtggttttccggcggtttcagctattgaaactacaccgtttggattcgggggtaaattcgtaaatcaagatgatcatctgaagttagaaggtgaaactgtacagcagcaacagtttggagatcgaacggctcaggttgagtttcaaggaagatcttcggatccgaatatgggatttgaaccgttggattggggaagtggcggtggagatcaaacactgtttgatttaaccagtaccgttgatcatgcatactggagtcaaagtcaatggacgtcgtctgaccaagatcagagtggtctctaccttccttga

SEQ ID NO: 2766 - protein, 307 aa, Arabidopsis thaliana
  G1904
MQDIHDFSMNGVGGGGGGGGRFFGGGIGGGGGGDRRMRAHQNNILNHHQSLKCPRCNSLNTKFCYYNNYNLSQPRHFCKNCRRYWTKGGVLRNVPVGGGCRKAKRSKTKQVPSSSSADKPTTTQDDHHVEEKSSTGSHSSSESSSLTASNSTTVAAVSVTAAAEVASSVIPGFDMPNMKIYGNGIEWSTLLGQGSSAGGVFSEIGGFPAVSAIETTPFGFGGKFVNQDDHLKLEGETVQQQQFGDRTAQVEFQGRSSDPNMGFEPLDWGSGGGDQTLFDLTSTVDHAYWSQSQWTSSDQDQSGLYLP

SEQ ID NO: 2767 - DNA, 795 bp, Arabidopsis thaliana
  G1906
atggtggaacgtgctcggatcgcaaaagtcccattgcctgaagcagctctaaattgccctagatgtgactcaaccaatactaagttctgttacttcaataactatagccttactcaacctcgccatttctgcaaaacatgtcgtcgctattggacacgtggcggttccttgaggaatgttcctgttggaggaggctttaggaggaacaagagaagcaaatccagatcgaaatctacggtcgtggtctcgactgataatactactagtacttcatcacttacttctcgcccaagttactcaaaccctagcaagtttcatagctacggtcaaatcccggagtttaattccaacttgcccatcttgcctcctctccaaagccttggagattacaattcaagcaacactggattagattttggtggaactcaaataagcaacatgataagtggtatgagttctagtggtgggatcttggatgcatggagaatacctccatcacaacaagctcagcaattccctttcttgatcaacactaccggattggtgcaatcttcaaacgcgttatatccattactagaaggcggggttagcgccacgcaaacaagaaatgtgaaggcggaagagaatgatcaggatcggggtagggatggggatggagtgaataacttatcaagaaactttttgggtaatatcaacataaactcaggcaggaacgaggaatacacatcatggggaggtaacagttcttggaccggtttcacctccaacaactcaacaggccatctctcattctaa

SEQ ID NO: 2768 - protein, 264 aa, Arabidopsis thaliana
  G1906
MVERARIAKVPLPEAALNCPRCDSTNTKFCYFNNYSLTQPRHFCKTCRRYWTRGGSLRNVPVGGGFRRNKRSKSRSKSTVVVSTDNTTSTSSLTSRPSYSNPSKFHSYGQIPEFNSNLPILPPLQSLGDYNSSNTGLDFGGTQISNMISGMSSSGGILDAWRIPPSQQAQQFPFLINTTGLVQSSNALYPLLEGGVSATQTRNVKAEENDQDRGRDGDGVNNLSRNFLGNININSGRNEEYTSWGGNSSWTGFTSNNSTGHLSF

SEQ ID NO: 2769 - DNA, 828 bp, Arabidopsis thaliana
  G1909
atgggtggatcgatggcggagagagcaaggcaggccaacattcctccactagcgggacccctaaagtgtcctcgatgcgactccagcaacactaagttctgttactacaacaactataacctcactcagcctcgtcacttctgcaaaggttgccgtcgctactggacacaagggggcgccctgagaaacgtccctgtaggtggaggctgccggaggaataacaagaagggcaaaaatggaaatttaaaatcttcttcttcttcgtccaaacagtcttcctcggtcaacgctcaaagtcctagctcaggacagctaaggacaaatcatcagttccctttttcaccaactctttacaatctcactcaactcggaggtattggtttgaacttagccgctactaatggcaacaaccaagctcaccagatcggttccagtttgatgatgagcgatctagggtttctccatggacgaaatacttcaactccgatgacgggaaacattcatgaaaacaacaacaataataacaatgaaaacaacctaatggcatccgttggatctttgagcccctttgctctcttcgatccaacgacggggctatacgctttccagaacgacggtaatatcgggaacaacgttgggatatctggttcttctacttccatggttgattctagggtttatcagacgcctccggtgaagatggaagaacaacctaatttggctaacttgtctagaccggtctccggtttgacgtctcctgggaatcaaacaaatcagtacttttggcctggttcggatttctcgggtccttctaatgatctcttgtga

SEQ ID NO: 2770 - protein, 275 aa, Arabidopsis thaliana
  G1909
MGGSMAERARQANIPPLAGPLKCPRCDSSNTKFCYYNNYNLTQPRHFCKGCRRYWTQGGALRNVPVGGGCRRNNKKGKNGNLKSSSSSSKQSSSVNAQSPSSGQLRTNHQFPFSPTLYNLTQLGGIGLNLAATNGNNQAHQIGSSLMMSDLGFLHGRNTSTPMTGNIHENNNNNNNENNLMASVGSLSPFALFDPTTGLYAFQNDGNIGNNVGISGSSTSMVDSRVYQTPPVKMEEQPNLANLSRPVSGLTSPGNQTNQYFWPGSDFSGPSNDLL

SEQ ID NO: 2771 - DNA, 744 bp, Arabidopsis thaliana
  G1913
atggagagagcagaggccttgacatcatcgtttatatggcggccaaacgcaaacgcaaacgcggagatcacgccgagttgtccaagatgtggatcctctaacacaaagttctgttactacaacaactatagcctcactcagcctcgctacttctgcaaaggctgccgcagatattggaccaaaggtggttccctccgcaatgttcctgtaggcggtggctgtcgaaaatcccgccgccccaaatcatcttctggtaacaatactaaaactagcctaaccgctaattctggcaaccccggtggtggttcaccaagcatcgatcttgctcttgtttacgccaatttcttgaatccaaagcctgacgaatctatactacaagaaaattgcgacttagccactacggattttttggtagataatcctaccggcacttccatggacccttcatggagtatggacatcaatgatggtcatcatgatcattatattaatccggtggaacacattgtggaggaatgtggttataatggcttgcctccatttcctggtgaagagcttctctctttagacactaatggtgtttggtctgatgctttgttgattggtcataaccatgtagacgttggcgtgactccggttcaggctgtacacgaaccggtggttcatttcgctgacgaatccaatgattccaccaatctcttgtttggaagttggagcccttttgatttcactgccgatggatga

SEQ ID NO: 2772 - protein, 247 aa, Arabidopsis thaliana
  G1913
MERAEALTSSFIWRPNANANAEITPSCPRCGSSNTKFCYYNNYSLTQPRYFCKGCRRYWTKGGSLRNVPVGGGCRKSRRPKSSSGNNTKTSLTANSGNPGGGSPSIDLALVYANFLNPKPDESILQENCDLATTDFLVDNPTGTSMDPSWSMDINDGHHDHYINPVEHIVEECGYNGLPPFPGEELLSLDTNGVWSDALLIGHNHVDVGVTPVQAVHEPVVHFADESNDSTNLLFGSWSPFDFTADG

SEQ ID NO: 2773 - DNA, 945 bp, Arabidopsis thaliana
  G1914
atggagagatacaagtgtagattttgcttcaagagcttcatcaatggaagagctttaggtggtcacatgagatctcacatgcttactctttctgcagaacgttgtgtaataactggtgaagcagaagaagaagtagaggaacggccgagtcaactctgtgacgacgacgacgataccgagtccgatgcttcttcttcttctggtgagtttgataatcaaaagatgaatcgtcttgatgatgaattggagtttgatttcgctgaagacgacgacgttgaaagtgaaaccgagtcgtccaggattaacccaactcggcgacgatctaaacgaactcggaaacttggatcgtttgatttcgactttgagaagctaacaacgagccaacccagtgagttagtggccgagccagagcatcacagctcagcttctgatacaacaacggaggaagatctcgccttttgtctcattatgctgtccagagacaaatggaagcaacagaagaagaagaagcaacgtgtagaagaagatgagacagatcatgacagtgaagattacaaatcaagcaagagcagagggagattcaagtgtgagacttgtggtaaagtgtttaaatcgtatcaagcattaggaggacacagagcaagccacaagaagaacaaggcatgcatgacgaaaacagagcaagttgaaacagagtacgttcttggagtaaaggagaagaaagttcatgaatgtccgatctgttttagggtttttacttcagggcaagcacttggaggtcataagagatctcacggaagtaacatcggagcaggaagaggattgtcagtaagtcaaattgtccaaatcgaagaagaagtatcagtgaaacagaggatgattgatcttaatcttcctgcacctaatgaagaagatgaaacttctttggtgtttgatgaatggtga

SEQ ID NO: 2774 - protein, 314 aa, Arabidopsis thaliana
  G1914
MERYKCRFCFKSFINGRALGGHMRSHMLTLSAERCVITGEAEEEVEERPSQLCDDDDDTESDASSSSGEFDNQKMNRLDDELEFDFAEDDDVESETESSRINPTRRRSKRTRKLGSFDFDFEKLTTSQPSELVAEPEHHSSASDTTTEEDLAFCLIMLSRDKWKQQKKKKQRVEEDETDHDSEDYKSSKSRGRFKCETCGKVFKSYQALGGHRASHKKNKACMTKTEQVETEYVLGVKEKKVHECPICFRVFTSGQALGGHKRSHGSNIGAGRGLSVSQIVQIEEEVSVKQRMIDLNLPAPNEEDETSLVFDEW

SEQ ID NO: 2775 - DNA, 945 bp, Arabidopsis thaliana
  G1925
atggaagaaaatcttcctccggggttcagatttcatcctacagacgaggagctcataacgcattatctatgtcggaaagtctccgatataggattcaccggtaaagctgtcgtcgacgttgatctcaacaagtgtgaaccttgggatttgccagccaaggcttcaatgggagagaaagagtggtatttcttcagccaaagggatcggaaatatccaaccggtttaagaacaaaccgggcaacagaagctggttactggaaaaccaccgggaaagataaagaaatataccgaagtggagtgttggttgggatgaagaaaaccctagttttctacaaaggaagagctcccaaaggtgagaaaagcaattgggttatgcatgagtacaggcttgagagcaaacaacctttcaaccccacgaataaggaggaatgggtagtgtgtagggttttcgaaaagagcacggcagcaaagaaagcacaagaacaacaacctcaatcttctcaaccatcttttggatctccatgcgatgcaaactcatcaatggcaaatgagtttgaagatattgatgagcttccgaatctgaattcaaactcatcaaccatcgattacaataatcatatccatcaatattcgcaacgcaatgtttactcagaagacaacacaacaagtacggctggtctcaacatgaacatgaacatggctagtactaatcttcagtcttggacaacaagtctccttggtccgcctttatctccaatcaactctttgttgctcaaggctttccaaatcaggaactcttatagtttcccaaaagagatgatccccagtttcaatcattcttctcttcaacaaggagtctccaatatgatccaaaatgcttcaagttcgtctcaagtgcaaccccaaccgcaagaggaagcgtttaatatggactccatatggtga

SEQ ID NO: 2776 - protein, 314 aa, Arabidopsis thaliana
  G1925
MEENLPPGFRFHPTDEELITHYLCRKVSDIGFTGKAVVDVDLNKCEPWDLPAKASMGEKEWYFFSQRDRKYPTGLRTNRATEAGYWKTTGKDKEIYRSGVLVGMKKTLVFYKGRAPKGEKSNWVMHEYRLESKQPFNPTNKEEWVVCRVFEKSTAAKKAQEQQPQSSQPSFGSPCDANSSMANEFEDIDELPNLNSNSSTIDYNNHIHQYSQRNVYSEDNTTSTAGLNMNMNMASTNLQSWTTSLLGPPLSPINSLLLKAFQIRNSYSFPKEMIPSFNHSSLQQGVSNMIQNASSSSQVQPQPQEEAFNMDSIW

SEQ ID NO: 2777 - DNA, 658 bp, Arabidopsis thaliana
  G1931
atcaatggaaggggttgacaacacaaatcctatgttaaccctagaagaaggcgaaaacaacaatcctttttcttccttagatgacaaaacattaatgatgatggctccttcgttaatcttttcgggcgatgtaggtccatcttcttcttcttgtactccagcaggttatcatctatctgctcagctggagaactttcgaggaggtggaggagagatgggaggattagtgagtaataatagcaataatagtgatcataataagaattgcaacaaaggaaaagggaagagaactttggcaatgcagaggatagcttttcatacaaggagtgatgatgatgttcttgatgatggttatcgttggcgaaagtacggtcagaaatctgtcaagaacaatgctcatcccaggagctattatagatgtacataccacacatgcaacgtgaagaaacaagtgcaaagactggcaaaagatccaaacgttgtcgtaacaacctacgaaggtgttcataatcatccttgtgagaagctcatggagactcttagccctctccttaggcaacttcagttcctctcaagagtttctgatctgtaattattgaatgttaattagtggtgtaatacattaattatgctttaatctctccattgaccctcaatc

SEQ ID NO: 2778 - protein, 195 aa, Arabidopsis thaliana
  G1931
MEGVDNTNPMLTLEEGENNNPFSSLDDKTLMMMAPSLIFSGDVGPSSSSCTPAGYHLSAQLENFRGGGGEMGGLVSNNSNNSDHNKNCNKGKGKRTLAMQRIAFHTRSDDDVLDDGYRWRKYGQKSVKNNAHPRSYYRCTYHTCNVKKQVQRLAKDPNVVVTTYEGVHNHPCEKLMETLSPLLRQLQFLSRVSDL

SEQ ID NO: 2779 - DNA, 1451 bp, Arabidopsis thaliana
  G1933
aattgagattaaagtaatttatctttcagaaaatggcggttgaagacgatgtatctttgataagaacgacgacgttagtggcaccaacaagacccacgattacagttcctcatagacctccggcgatcgaaacggcggcgtatttctttggcggtggagatgggcttagtctaagcccagggccactttcttttgtctcttctttgtttgttgataacttccctgacgtcttgacgccggataaccaacggacgacgtcgtttactcagcttcttaacggaactatgtcggtgtctcctggtggcggaggacgttcaacggcggggatgttcgccggaggaggtccgatgtttacaatcccttctggtttcagcccttctagtcttctcacctcgcccatgttctttcccccgcagtcgtcagctcataccggctttattcaaccacggcagcagtcacaaccgcaaccacaacgaccagacacgtttcctcaccatatgccaccatcgacatccgtcgccgtccatggtcgtcaatctttagacgtttcacaagtagatcaaagagctcgaaaccattataataatccggggaataacaataataaccggtcgtataacgttgtgaacgttgataaaccggcggatgacggttataactggaggaagtacggacaaaagcctatcaaagggtgtgaatatccaaggagttattacaaatgtacacatgttaactgtccggtgaagaagaaagtcgaacggtcatcggatggacagatcactcagatcatttacaaaggtcaacatgatcacgagaggcctcagaatcgccgtggcggtggaggcagagattccactgaggttggtggtgcagggcaaatgatggaatctagtgatgatagtggttatcgtaaggatcatgatgatgatgatgatgatgatgaagatgatgaagatcttccggcttcaaagataagaagaatagacggtgtgtcgacgactcaccggacggtgaccgagcctaagattatcgttcagacaaaaagtgaagtcgatcttctcgacgatggctataggtggcgtaagtacggacaaaaagttgtcaaaggaaatccccatccaaggagctattataaatgtacaacgccaaattgtacggtccgtaaacatgtagagagagcttccacggatgctaaggctgtgattacaacttacgaaggtaaacacaatcacgatgtccctgccgctagaaacggtaccgcggcagcaaccgcagctgcggtggggccgtctgaccaccatcgtatgagatcaatgtcggggaacaatatgcaacaacatatgagtttcggtaacaataataacacaggccaatctccggttcttttgaggttgaaagaagagaaaatcacaatttgacttttaagaaccaaagatttcgagattgatatt

SEQ ID NO: 2780 - protein, 461 aa, Arabidopsis thaliana
  G1933
MAVEDDVSLIRTTTLVAPTRPTITVPHRPPAIETAAYFFGGGDGLSLSPGPLSFVSSLFVDNFPDVLTPDNQRTTSFTQLLNGTMSVSPGGGGRSTAGMFAGGGPMFTIPSGFSPSSLLTSPMFFPPQSSAHTGFIQPRQQSQPQPQRPDTFPHHMPPSTSVAVHGRQSLDVSQVDQRARNHYNNPGNNNNNRSYNVVNVDKPADDGYNWRKYGQKPIKGCEYPRSYYKCTHVNCPVKKKVERSSDGQITQIIYKGQHDHERPQNRRGGGGRDSTEVGGAGQMMESSDDSGYRKDHDDDDDDDEDDEDLPASKIRRIDGVSTTHRTVTEPKIIVQTKSEVDLLDDGYRWRKYGQKVVKGNPHPRSYYKCTTPNCTVRKHVERASTDAKAVITTYEGKHNHDVPAARNGTAAATAAAVGPSDHHRMRSMSGNNMQQHMSFGNNNNTGQSPVLLRLKEEKITI

SEQ ID NO: 2781 - DNA, 1172 bp, Arabidopsis thaliana
  G1939
aatcattagcttcttctcttctcttctctcacagagagagtaatcacaagccaagtgagaaaaagaaaacactaaacccagatcgaaaaccatgtctattaacaacaacaacaacaacaacaacaataacaacgatggtcttatgatctcatcaaacggagctttaatcgaacaacaaccatcagtcgttgtgaagaaaccaccggcgaaagatcgacatagcaaagtcgatggaagagggagaagaatccgtatgccgattatatgtgctgctcgtgtttttcagctaacgagagagcttggtcataagtcagatggccaaacaattgaatggttacttcgtcaagcagagccttctattatagctgcaacaggaactggtacaactccagcgagtttctcaactgcttctgtctctatccgtggagccaccaattctacttctttagatcataaacccacttctttacttggtggtacgtcaccgtttatacttgggaaacgtgttagagctgatgaggatagtaataatagtcataatcatagttctgttggtaaagatgagacctttacgacaacaccagctgggttttgggctgttccggcgaggccggattttggacaagtttggagttttgctggagctccacaagagatgtttttacaacaacaacatcatcatcagcaaccattgtttgttcatcagcaacagcaacaacaagctgcaatgggtgaagcttctgctgctagagttgggaattatcttccgggtcatcttaatttgcttgcttctttatccggtggatctcccgggtcggatcgaagagaggaagatccacgttaatggtttaagcccttttaggtttgagggcaaaatttggtatatatatttattatcttctcttctctattgttgtcattgtttctctatgtgtgtgttttagtgttgttagagattgatttggtttcagaatctctgcaagtgatttgagagttttcgttagctttaagtaagttaaagacggttgtttttgattagggttaaattagggtttaagaatctgttgtttttttggagggagatcgatttcttatcggatccaagattacttttaggaaaaaagggaaaatttcagaaaccacggtggtttcttttcctctttttttttttg

SEQ ID NO: 2782 - protein, 250 aa, Arabidopsis thaliana
  G1939
MSINNNNNNNNNNNDGLMISSNGALIEQQPSVVVKKPPAKDRHSKVDGRGRRIRMPIICAARVFQLTRELGHKSDGQTIEWLLRQAEPSIIAATGTGTTPASFSTASVSIRGATNSTSLDHKPTSLLGGTSPFILGKRVRADEDSNNSHNHSSVGKDETFTTTPAGFWAVPARPDFGQVWSFAGAPQEMFLQQQHHHQQPLFVHQQQQQQAAMGEASAARVGNYLPGHLNLLASLSGGSPGSDRREEDPR

SEQ ID NO: 2783 - DNA, 2245 bp, Arabidopsis thaliana
  G1943
acatttgtttctaatctcagacataaataatttttgttcccgacttcaaaaccaacgatgattatatcattccacattcattttcttctacttcttccttctccttgatctcatttccctagaaaatccatctatcatgggtgaagatgatatagtggagctcttatggaagagtggccaagtcgttagaaccagtcaaacacagagaccctcctccaatacaccaccatctcttcctccaccacccattcttcgtggtagcggaagcggcaacggagaagaaaatgccccgcttccacttccacagccttcacctcccctccatcatcagaatcttttcattctggaagacgaaatgtcttcttggcttcaccattctcaccccggcgttacgtccaccccggcttcttctgtctccctgccaccaccacccaatgctccgcgtgaagatgatatagtggagcttttatggcaaagcggccaagtagttggaaccaaccaaacacatagacaatcctacgatcctcctcccattctccgcggcagcggaagtggcagaggagaagaaaatgctcccctttcacaacctccgcctcacctgcatcagcaaaatctcttcattcaagaaggcgaaatgtattcgtggctacaccattcttaccgccaaaactatttctgctcagaacttctcaactccactccggctactcacccgcaaagttccatctctctggcaccacgtcagactatcgccacgagaagggcggaaaactttatgaacttctcgtggctaagagggaacatatttaccggcggtagagttgatgaagctggaccgtcgttttcggtggtaagagaatcgatgcaggtaggctcgaacacgacccccccttcttcttctgccactgaatcatgtgtaataccagctacagagggcaccgcgagtcgagtgtcgggaactttggcagctcatgatcttggtcggaagggaaaggcggtggcggttgaggcggccggaacaccatcttcaggagtgtgcaaggccgaaacagagccggttcagatacaaccagcaacggagtcgaagctaaaagcgagagaagaaacccatggaactgaagaagctcgtggttcaacgtctagaaagagatcacgaactgcagaaatgcataacctcgccgaaaggagaaggagagaaaagatcaacgagaagatgaagactctgcaacaactcattcctcgctgcaacaaggttgaatctgattctgtttctactctgatcagtctactaaagtttcaacgctggatgatgctatcgagtacgtcaaatcgttacagagccaaatacaagtatgctcttcaaaacagaatgtgttttaaaccaatggttcaacatggaaagagttcatatgtatctagttttgttgagatgatgtcgacgggacagggtatgatgtcgccaatgatgaatgccgggaatacgcaacagttcatgccccatatggccatggatatgaaccgacctcctccattcatacctttccccggcacatcttttcctatgccggctcaaatggcaggtgtaggtccatcatatccagcaccgcgctacccttttcccaacattcagacctttgacccatccagagtccgtttaccaagcccgcagcctaacccggtgtcgaaccagcctcagtttccggcttacatgaatccctatagccagtttgctggtccccaccagttgcaacaacctcctcctcctccatttcagggtcaaacaacatcacaactgagttccgggcaggcaagtagtagcaaggaacctgaggatcaggagaaccaaccaacagcttagttaaagtgtggagctgaaacggatcagttcttcaagcaaattacaactttgaagataaaccagagttgtaacatgtagattttgtctgttaagtttaatgtaagtactttttagttaatgggaaagatactgacaggttgcaaggtggtcagtatttgtgcatcacgcttaagattcctcgatgtggccagtatctcccttttctagcatgtgaggtccctactctctggttctacggagaccaaatgttcgactgattaaacacacaatgacttaccaaaagtacacgcggcccatcctcgtctttatgttccaagtgcgactgtttgtttatttgtaagcatttttcttataataataaaacagctctatcttcgttaaaaaaaa

SEQ ID NO: 2784 - protein, 573 aa, Arabidopsis thaliana
  G1943
MGEDDIVELLWKSGQVVRTSQTQRPSSNTPPSLPPPPILRGSGSGNGEENAPLPLPQPSPPLHHQNLFILEDEMSSWLHHSHPGVTSTPASSVSLPPPPNAPREDDIVELLWQSGQVVGTNQTHRQSYDPPPILRGSGSGRGEENAPLSQPPPHLHQQNLFIQEGEMYSWLHHSYRQNYFCSELLNSTPATHPQSSISLAPRQTIATRRAENFMNFSWLRGNIFTGGRVDEAGPSFSVVRESMQVGSNTTPPSSSATESCVIPATEGTASRVSGTLAAHDLGRKGKAVAVEAAGTPSSGVCKAETEPVQIQPATESKLKAREETHGTEEARGSTSRKRSRTAEMHNLAERRRREKINEKMKTLQQLIPRCNKVESDSVSTLISLLKFQRWMMLSSTSNRYRAKYKYALQNRMCFKPMVQHGKSSYVSSFVEMMSTGQGMMSPMMNAGNTQQFMPHMAMDMNRPPPFIPFPGTSFPMPAQMAGVGPSYPAPRYPFPNIQTFDPSRVRLPSPQPNPVSNQPQFPAYMNPYSQFAGPHQLQQPPPPPFQGQTTSQLSSGQASSSKEPEDQENQPTA

SEQ ID NO: 2785 - DNA, 1750 bp, Arabidopsis thaliana
  G1954
atttatgacttctcaatacaaaaagctcccctcacttttttaagttttgtcttctctaatccgtcttcttctactatcttgcatgtcttgcgtcttttatatacatctctcgtaaaccctagcaaatcatacaaggtcaagaagcttgaccttcattagacttaagcagtttataatcaactaccacgaatagcaatggataaagattactcggcaccaaacttcttaggtgaatcctcaggcggtaacgatgataacagctctggtatgatagactatatgttcaatagaaaccttcaacaacaacaaaagcaatcgatgccacaacagcagcaacatcaactctctccttccggatttggagcaacaccctttgataaaatgaacttctctgatgtgatgcagtttgcggacttcggttcgaaacttgcgttgaaccagaccagaaaccaagacgatcaagaaaccgggattgaccccgtttatttcttgaagttccctgtcttgaacgacaaaatagaggaccataaccaaacccaacatctcatgccttctcatcagacgtctcaagaaggaggtgagtgtggaggaaacataggcaatgtgtttcttgaagaaaaagaagatcaagacgatgacaacgacaacaactccgtgcaactacgttttattggaggagaagaagaagatagggagaacaagaatgttacgaaaaaggaggtgaagagcaagaggaagagagctagaacgagcaagaccagcgaagaagtggaaagccaacggatgactcatatcgcggtcgaaagaaaccgtaggaagcaaatgaatgagcatcttcgtgtccttagatctctcatgcctggctcctacgttcaaaggggagaccaagcgtcaatcataggaggagcaatagagtttgtgagagagctcgagcaactcctacaatgtcttgaatcacagaagcgtcgaagaatcttaggagaaaccggtagggacatgacaacgacaacgacttcttcttcttctcccataactacggtagcgaaccaagcacaaccgctcattattacgggaaatgtaaccgagctagagggcggaggagggcttcgggaggagactgcggagaacaagtcgtgcttggctgacgtggaggtgaagctgctagggtttgacgccatgatcaagatactttcaagaagaaggccgggacagctgattaagactatagctgctttggaggatcttcatctctctattcttcacactaacatcactaccatggaacaaaccgtcctctactcctttaatgtcaagataacaagtgaaacgaggtttacggcagaagacatagcaagttccatccaacagatatttagtttcattcatgcaaataccaacatatctggaagctctaacctgggaaatattgtgtttacttgaaaatcatcacacggcgacaactttgtacactggtgaagattacagtacgtaataatctctacatattgggttttattctccaagcatttggaagagtgtttaagttaaagggagtgcttactttatttttttggggcttttttcatgcaatttaaattttagtgatgattgtgtcgcttgtaatgttagaactcgttgttgtgatttctgctgctttgatttgtaggttttgaacaagcggtttagaatgctaaaccacttatttacttgaaataacttttttcacaaaaaaaaaaaaaaaagaaaaaaa

SEQ ID NO: 2786 - protein, 414 aa, Arabidopsis thaliana
  G1954
MDKDYSAPNFLGESSGGNDDNSSGMIDYMFNRNLQQQQKQSMPQQQQHQLSPSGFGATPFDKMNFSDVMQFADFGSKLALNQTRNQDDQETGIDPVYFLKFPVLNDKIEDHNQTQHLMPSHQTSQEGGECGGNIGNVFLEEKEDQDDDNDNNSVQLRFIGGEEEDRENKNVTKKEVKSKRKRARTSKTSEEVESQRMTHIAVERNRRKQMNEHLRVLRSLMPGSYVQRGDQASIIGGAIEFVRELEQLLQCLESQKRRRILGETGRDMTTTTTSSSSPITTVANQAQPLIITGNVTELEGGGGLREETAENKSCLADVEVKLLGFDAMIKILSRRRPGQLIKTIAALEDLHLSILHTNITTMEQTVLYSFNVKITSETRFTAEDIASSIQQIFSFIHANTNISGSSNLGNIVFT

SEQ ID NO: 2787 - DNA, 1116 bp, Arabidopsis thaliana
  G1959
cgtcgactgtccataaatccggagcctgacccgacgtttgacccggatccgaaactcccacaatctccataccacccaaattcatctcccctaaagctttctctcactttcccgggaaaatcggcgaccaaaattggaaaatgtactcagcgattcgctcgcttccactcgatggtggacacgttggtggtgactaccatggacctcttgacggaaccaatcttcccggtgacgcttgtttggttttaacgactgaccctaaacctcgtctccggtggacaactgagcttcatgagagattcgttgacgccgttactcagctcggtggtcctgacaaagcgactcccaaaactattatgagaacaatgggagtgaagggtctcactctctaccacctcaaatcacatcttcagaaattccgcctagggaggcaagctggcaaagaatcaactgagaactctaaagatgcttcttgtgtaggggagagtcaggacacaggttcatcttcgacatcatcaatgagaatggcgcagcaggagcagaacgagggttaccaagtcaccgaagctctacgtgctcagatggaagtccaaagaagactacacgatcaattggaggtgcaacggaggctccagctgaggatagaggcacaaggaaaatacctgcaatcgattcttgaaaaagcttgcaaggcctttgacgagcaagctgctacttttgctggacttgaggctgctagggaagagctatcagagctagccatcaaagtctccaatagctctcaaggaacatcagtcccgtacttcgatgcaacaaagatgatgatgatgccatcgttgtcagagcttgcagtagcaatagacaacaaaaacaacatcacaaccaactgttcagtagaaagctctctgacttccatcacacatgggagctctatatctgctgcatcaatgaagaagcgtcaacgtggagacaatttgggcgtagggtatgaatcaggctggattatgcctagtagcaccattggataaagtttaggagagggaaaaagttcattatgggaaaggtagagataagatttaactgttctttacttgctttgaggggcctgcggccgct

SEQ ID NO: 2788 - protein, 295 aa, Arabidopsis thaliana
  G1959
MYSAIRSLPLDGGHVGGDYHGPLDGTNLPGDACLVLTTDPKPRLRWTTELHERFVDAVTQLGGPDKATPKTIMRTMGVKGLTLYHLKSHLQKFRLGRQAGKESTENSKDASCVGESQDTGSSSTSSMRMAQQEQNEGYQVTEALRAQMEVQRRLHDQLEVQRRLQLRIEAQGKYLQSILEKACKAFDEQAATFAGLEAAREELSELAIKVSNSSQGTSVPYFDATKMMMMPSLSELAVAIDNKNNITTNCSVESSLTSITHGSSISAASMKKRQRGDNLGVGYESGWIMPSSTIG

SEQ ID NO: 2789 - DNA, 609 bp, Arabidopsis thaliana
  G1965
atggataacttcaatgttgttgccaatgaagacaatcaagtgaatgatgtgaagcctccaccacccccaccgcgagtgtgtgcaagatgtgattctgataacacaaaattttgttactacaacaattatagtgagtttcaaccgcgctacttctgcaagaactgtcgaagatactggactcatggtggggctttaagaaacgtaccaattggtgggagtagtcgtgccaagcggacaaggataaatcaaccttcagttgctcagatggtttctgttggaatccaaccagggaaccgttttagttctttgtctcatattcatggtggtatggtaacaaatgtgcatccaactcaaacttttcgaccaaatcatcgcctagctttccataatggatcatttgagcaagattattatgatgttgggtctgataatcttttggtaaaccaacaagttggtggatatgttgataatcacaacggttatcacatgaatcaagtggatcaatacaactggaaccagagcttcaataacgctatgaacatgaattataataacgctagcactagcggaaggatgcatcctagtcatttagagaagggtggtccttga

SEQ ID NO: 2790 - protein, 202 aa, Arabidopsis thaliana
  G1965
MDNFNVVANEDNQVNDVKPPPPPPRVCARCDSDNTKFCYYNNYSEFQPRYFCKNCRRYWTHGGALRNVPIGGSSRAKRTRINQPSVAQMVSVGIQPGNRFSSLSHIHGGMVTNVHPTQTFRPNHRLAFHNGSFEQDYYDVGSDNLLVNQQVGGYVDNHNGYHMNQVDQYNWNQSFNNAMNMNYNNASTSGRMHPSHLEKGGP

SEQ ID NO: 2791 - DNA, 1152 bp, Arabidopsis thaliana
  G1976
atgactgatccttattccaatttcttcacagactggttcaagtctaatccttttcaccattaccctaattcctccactaacccctctcctcatcctcttcctcctgttactcctccctcttccttcttcttcttccctcaatccggagacctccgccgtccaccgccgccaccaactcctcctccttctcctcctctccgagaagccctccctctcctcagcctcagccccgccaacaaacaacaagaccaccatcacaaccatgaccaccttattcaagaaccaccttcaacctccatggatgtcgactacgatcatcaccatcaagatgatcatcataacctcgatgacgatgaccatgacgtcaccgttgctcttcacataggccttccaagccctagtgctcaagagatggcctctttgctcatgatgtcttcttcttcctcttcctcgaggaccactcatcatcacgaggacatgaatcacaagaaagacctcgaccatgagtacagccacggagctgtcggaggaggagaagatgacgatgaagattcagtcggcggagacggcggctgtagaatcagcagactcaacaagggtcaatattggatccctacaccttctcagattctcattggccctactcagttctcatgtcctgtttgcttcaaaaccttcaacagatacaataacatgcagatgcatatgtggggacatggatcacaatacagaaaaggacctgaatctctaaggggaacacaaccaacaggaatgctaaggcttccgtgctattgctgcgccccaggctgtcgcaacaacattgaccatccaagggcaaagcctctcaaagacttcagaacccttcaaacacattacaagagaaaacatgggatcaaacctttcatgtgtaggaaatgtggaaaggctttcgcagtccgaggggactggagaacacatgagaagaattgtggcaaactttggtattgcatatgtggatctgatttcaagcacaagagatctctcaaagatcacatcaaggcttttgggaatggtcatggagcctacggaattgatgggtttgatgaagaagatgagcctgcctctgaggtagaacaattagacaatgatcatgagtcaatgcagtctaaatag

SEQ ID NO: 2792 - protein, 383 aa, Arabidopsis thaliana
  G1976
MTDPYSNFFTDWFKSNPFHHYPNSSTNPSPHPLPPVTPPSSFFFFPQSGDLRRPPPPPTPPPSPPLREALPLLSLSPANKQQDHHHNHDHLIQEPPSTSMDVDYDHHHQDDHHNLDDDDHDVTVALHIGLPSPSAQEMASLLMMSSSSSSSRTTHHHEDMNHKKDLDHEYSHGAVGGGEDDDEDSVGGDGGCRISRLNKGQYWIPTPSQILIGPTQFSCPVCFKTFNRYNNMQMHMWGHGSQYRKGPESLRGTQPTGMLRLPCYCCAPGCRNNIDHPRAKPLKDFRTLQTHYKRKHGIKPFMCRKCGKAFAVRGDWRTHEKNCGKLWYCICGSDFKHKRSLKDHIKAFGNGHGAYGIDGFDEEDEPASEVEQLDNDHESMQSK

SEQ ID NO: 2793 - DNA, 1677 bp, Arabidopsis thaliana
  G2011
aatgtcggttgtacaattatttgtcactaaagtttccaaatttcttctaaactgatgaatcaatggaacatgatgacgaaaaagataaatccacggtggcgggaactgacccacccatttccaccgcctctctattccccagatttttttcaattatctgactacagtttgtcggttacttccttccctaaacctttataaaccattaaacctctcatccttcttctcttaaaccccctaattatcacacacaccccaatttctcactctctctctcactaaaacccgtaaattttctactatatcaaatgagcccaaaaaaagatgctgtttctaaaccaactccaatttcagtacccgtttcgagacgatccgatatacccgggtctctctacgtcgacactgacatgggtttctctgggtcaccacttcccatgccactagacatcttacaagggaatccaattccaccttttttatccaagacttttgatttggttgatgacccgactcttgacccggtcatctcttggggactgaccggagctagcttcgtagtttgggatcctctagagtttgccagaatcatacttccaaggaatttcaaacacaacaatttctccagcttcgtcagacagcttaacacttatggatttcgaaagattgatactgacaagtgggaattcgctaacgaggctttccttagaggcaagaagcatcttctgaagaacattcatcgtcgtcgatcaccacaatccaaccaaacttgctgcagtagcactagccaaagccaagggtcacctactgaggttggaggagagattgagaagctgaggaaagagcggcgtgcattgatggaggaaatggttgagcttcagcagcaaagcagaggcacagctcgacatgtggacactgtaaaccagaggctgaaagctgcagagcaacgtcagaagcaattgctctctttcttggctaagttgtttcagaaccggggtttcttggaacgcctgaagaacttcaaaggaaaagaaaaaggaggagctcttggattggaaaaggcgagaaagaagttcatcaagcaccaccagcagcctcaagattctccaacaggaggggaggtggtgaagtatgaagctgatgattgggagagattgctaatgtatgacgaagagactgagaacaccaagggtttaggagggatgacttcaagcgatccaaaaggcaagaacttgatgtatccatcagaagaagagatgagcaaaccagattacttgatgtccttcccatctcctgaaggacttattaaacaagaagagacgacatggagcatgggtttcgatactacaataccgagtttcagcaacaccgatgcatggggaaacacaatggactataatgatgtctcagagtttggttttgctgcagaaacaacaagtgatggtttgcctgatgtctgctgggaacaatttgctgcaggaatcacagagactggattcaactggccaactggtgatgatgatgataatacgccaatgaatgatccttaggatcttttcatatatagtttagaccaaaaacccgtttcttatcgggtgaactattaattcattattcattttgaatgcactctttatacatatatataatattgatgagtttgattgttccaaaaaaaaa

SEQ ID NO: 2794 - protein, 412 aa, Arabidopsis thaliana
  G2011
MSPKKDAVSKPTPISVPVSRRSDIPGSLYVDTDMGFSGSPLPMPLDILQGNPIPPFLSKTFDLVDDPTLDPVISWGLTGASFVVWDPLEFARIILPRNFKHNNFSSFVRQLNTYGFRKIDTDKWEFANEAFLRGKKHLLKNIHRRRSPQSNQTCCSSTSQSQGSPTEVGGEIEKLRKERRALMEEMVELQQQSRGTARHVDTVNQRLKAAEQRQKQLLSFLAKLFQNRGFLERLKNFKGKEKGGALGLEKARKKFIKHHQQPQDSPTGGEVVKYEADDWERLLMYDEETENTKGLGGMTSSDPKGKNLMYPSEEEMSKPDYLMSFPSPEGLIKQEETTWSMGFDTTIPSFSNTDAWGNTMDYNDVSEFGFAAETTSDGLPDVCWEQFAAGITETGFNWPTGDDDDNTPMNDP

SEQ ID NO: 2795 - DNA, 1838 bp, Arabidopsis thaliana
  G2032
tccctcccagagtaagaacttccatactttgctctagatttcttgagaaaagatgcagccgatcttccatgcgatccttaaaaatgaccttccagcttttttagagttggtagaagatagtgaatcgtctctggaggagagaaacgaggaagaacacttgaacaacacggttttgcacatggctgcaaagtttggtcaccgagaactcgtctccaagattattgagctccgaccttccctcgtgtcttcccgcaacgcatacagaaacacacctttgcatcttgctgctatccttggagatgtaaacatagttatgcagatgttagagactggattggaagtgtgttctgcacgcaatatcaacaaccacacaccactccacttggcttgccgtagcaattccatagaggctgccagactcatcgcggaaaagacacaatcaattggcctcggtgaactcattctcgccatatcaagtggatccactagtatcgtagggactatactggagagattcccagacctagctagggaagaagcttgggtggttgaagacggctcacaatcaacgctactgcatcatgcgtgtgataagggagactttgaactgacaactatattgttagggctcgatcaaggattagaagaagcacttaaccccaatggtttatcacctctgcatcttgcggtcctcagaggctcggttgtgatcctggaggagttcttggacaaggttccattgtctttcagctcaatcacgccgtcgaaagagacagtctttcatctcgctgctcgaaacaaaaatatggatgcctttgtttttatggcagagagtttgggaattaacagccaaattcttctacagcaaaccgatgaaagtggcaacactgtcttacatattgctgcatccgtctcttttgatgctcctcttatacgttacattgttggtaagaatatagtagatatcacgtccaagaacaagatgggttttgaagcttttcaacttctccctcgagaagcccaagactttgagttgttatcaaggtggctgagatttggtaccgagacttcacaagagctggattctgagaacaatgtagaacaacacgaaggctctcaagaggtcgaggtaatacggttgctaaggattataggaataaacacatcagagatagcagagagaaagagaagcaaggaacaggaagtggaaagaggtcgtcagaacttggaatatcagatgcatatagaagcattacagaatgcaagaaatacgattgctatagtggcagtcttgattgcttcagttgcttatgccggtgggataaaccctccggggggcgtctaccaagacgggccatggagagggaaatccttagtggggaaaacaacggcgtttaaggtctttgcgatatgcaacaacatcgcactgttcacgtccttgggcatcgttattcttcttgttagcatcataccttacaagaggaaacccttaaagagattattggtggccacgcataggatgatgtgggtttctgtaggtttcatggcgacggcttatatagcggcgtcttgggtgaccataccgcattatcatggaacacaatggttatttccagcaattgtagccgttgctggtggagcgttgaccgtactctttttctatctcggagttgagaccatcggtcattggtttaagaagatgaatcgtgtaggggataatataccttcctttgcaagaaccagttcagatttagccgtctccggaaaatcaggctatttcacctattaagaaaaactggttttctaatttccctgtaacctgtgtaattgtgtatgtg

SEQ ID NO: 2796 - protein, 578 aa, Arabidopsis thaliana
  G2032
MQPIFHAILKNDLPAFLELVEDSESSLEERNEEEHLNNTVLHMAAKFGHRELVSKIIELRPSLVSSRNAYRNTPLHLAAILGDVNIVMQMLETGLEVCSARNINNHTPLHLACRSNSIEAARLIAEKTQSIGLGELILAISSGSTSIVGTILERFPDLAREEAWVVEDGSQSTLLHHACDKGDFELTTILLGLDQGLEEALNPNGLSPLHLAVLRGSVVILEEFLDKVPLSFSSITPSKETVFHLAARNKNMDAFVFMAESLGINSQILLQQTDESGNTVLHIAASVSFDAPLIRYIVGKNIVDITSKNKMGFEAFQLLPREAQDFELLSRWLRFGTETSQELDSENNVEQHEGSQEVEVIRLLRIIGINTSEIAERKRSKEQEVERGRQNLEYQMHIEALQNARNTIAIVAVLIASVAYAGGINPPGGVYQDGPWRGKSLVGKTTAFKVFAICNNIALFTSLGIVILLVSIIPYKRKPLKRLLVATHRMMWVSVGFMATAYIAASWVTIPHYHGTQWLFPAIVAVAGGALTVLFFYLGVETIGHWFKKMNRVGDNIPSFARTSSDLAVSGKSGYFTY

SEQ ID NO: 2797 - DNA, 1307 bp, Arabidopsis thaliana
  G2057
gccgtctcgacgaatatgctctaccaatgtctgacgaccaattccatcacccgccgcctccttcttcaatgaggcaccgttctacgtcggatgcggcggacggcggctgcggcgagattgttgaggtgcaaggtggtcacattgttcggtctaccggaagaaaagaccgccacagcaaagtctgcacggctaaagggccacgtgaccggcgcgtgagactctctgctcacacggcgattcagttttacgatgttcaagacaggcttggtttcgaccgacctagcaaagccgttgattggcttatcaaaaaggctaagacttccattgacgagctcgctgagcttcctccctggaatcccgccgatgcaattcgcctagccgctgctaacgctaaacccagaagaaccaccgccaaaacccaaatctctccgtctccgccaccgccgcaacagcaacaacaacaacaacagcttcagttcggtgttggcttcaacggaggaggagcagagcatccgagtaacaacgagtcgagttttctcccgccgtcaatggattcagattcgatagctgacactataaagtcgttttttccggtgattggctcttcaacggaggctccttcgaatcataaccttatgcacaactatcatcatcagcatccgccggatttgctttctcgaactaatagccaaaaccaagatctccgtctctcgctgcaatcgttcccggatggtccaccgtcgcttctgcaccaccaacatcaccaccacacctctgcttccgcctccgagcctactctgttctacggacagagcaatccgttagggtttgacacatcgagttgggagcagcagtcgtcggaattcggaaggattcagagactagtggcttggaacagcggcggtggcggcggagcaaccgatacaggaaacggaggagggtttctgttcgctcctcctactccttcaacgacgtcgtttcagccagttcttggccaaagccaacagctttattctcagaggggtccccttcagtccagttacagtcccatgatccgtgcttggtttgatcctcaccatcatcaccaatccatctccaccgacgatctcaaccaccaccatcaccttcctccaccggttcaccaatcagcaatccccggaatcggattcgcctcaggtgaattctcttcgggttttcgcataccagcacggtttcagggccaagaagaggagcagcacgacggtctcactcacaagccgtcctctgcttcctctatttctcgccattgacaatcgaaactaatcctc

SEQ ID NO: 2798 - protein, 420 aa, Arabidopsis thaliana
  G2057
MSDDQFHHPPPPSSMRHRSTSDAADGGCGEIVEVQGGHIVRSTGRKDRHSKVCTAKGPRDRRVRLSAHTAIQFYDVQDRLGFDRPSKAVDWLIKKAKTSIDELAELPPWNPADAIRLAAANAKPRRTTAKTQISPSPPPPQQQQQQQQLQFGVGFNGGGAEHPSNNESSFLPPSMDSDSIADTIKSFFPVIGSSTEAPSNHNLMHNYHHQHPPDLLSRTNSQNQDLRLSLQSFPDGPPSLLHHQHHHHTSASASEPTLFYGQSNPLGFDTSSWEQQSSEFGRIQRLVAWNSGGGGGATDTGNGGGFLFAPPTPSTTSFQPVLGQSQQLYSQRGPLQSSYSPMIRAWFDPHHHHQSISTDDLNHHHHLPPPVHQSAIPGIGFASGEFSSGFRIPARFQGQEEEQHDGLTHKPSSASSISRH

SEQ ID NO: 2799 - DNA, 1153 bp, Arabidopsis thaliana
  G2065
aaccacacaaaacaaaacaaaaaaacatattgatggggatgaagaaggtaaagctatctttgatagctaatgaaagatcaaggaaaacatccttcatgaagaggaaaaacgggatattcaagaaactccacgagttgtcaactctatgtggtgtccaagcttgtgctctcatctatagtccattcataccggttccagagtcatggccgtcaagggaaggtgctaaaaaggtagcttcaaagtttctggagatgccgcggacagcccgaaccaggaagatgatggatcaagaaacccatcttatggagaggattaccaaagcaaaagagcaactaaagaatttggctgctgagaaccgagaattacaggttagacgatttatgtttgattgtgttgaaggcaaaatgtcccagtatcgttatgatgcaaaagaccttcaagatttgctatcttgtatgaatctatatctcgatcagcttaacggaaggatcgagtccattaaagaaaacggtgagtcgttgttgtcttccgtctctccttttcctactagaattggtgttgacgaaattggtgatgagtcgttttccgactctcctattcattctacaactagggttgtagatactcctaatgctaccaatcctcatgttcttgcgggcgatatgactccttttcttgatgcggacgcaaatgcggtaactgctcccagtcgattttctgatcatattcaatatgaaaatatgaatatgagtcaaaatctgcatgaaccgtttcaacaccttgttcctactaacgtttgtgatttttatcaaaatcagaatatgaatcaggttcaataccaggctcctaataatctgtttaatcagattcaacgagaattctacaacataaatttgaatctgaatttgaatctgaattcaaatcagtatctgaatcaacaacaatcattcatgaatccgatggtggaacaacatatgaatcatgttggagggcgtgaaagcattcctttcgtggacagaaactactacaactacaatcaactaccagccgttgatcttgcttccaccagttacatgccttcaaccaccgatgtttatgatccttacatcaacaacaatctctaatcacaaaagacggagattttctagtttaa

SEQ ID NO: 2800 - protein, 363 aa, Arabidopsis thaliana
  G2065
MGMKKVKLSLIANERSRKTSFMKRKNGIFKKLHELSTLCGVQACALIYSPFIPVPESWPSREGAKKVASKFLEMPRTARTRKMMDQETHLMERITKAKEQLKNLAAENRELQVRRFMFDCVEGKMSQYRYDAKDLQDLLSCMNLYLDQLNGRIESIKENGESLLSSVSPFPTRIGVDEIGDESFSDSPIHSTTRVVDTPNATNPHVLAGDMTPFLDADANAVTAPSRFSDHIQYENMNMSQNLHEPFQHLVPTNVCDFYQNQNMNQVQYQAPNNLFNQIQREFYNINLNLNLNLNSNQYLNQQQSFMNPMVEQHMNHVGGRESIPFVDRNYYNYNQLPAVDLASTSYMPSTTDVYDPYINNNL

SEQ ID NO: 2801 - DNA, 1026 bp, Arabidopsis thaliana
  G2069
atggaaggaggaggaagaggaccaaatcaaacgattctcagtgaaatagaacatatgcctgaagctccacgtcaacgtatctctcatcaccgtcgagctcgctctgaaaccttcttctccggcgaatcaatcgacgatctcctcttattcgatccttccgatatcgatttctcttctctagacttcctcaacgctccaccaccaccacaacaatcacaacaacaaccgcaagcttctcccatgtccgttgattcggaagaaacctcatcgaacggtgttgttcctcctaattctcttcctccaaaacccgaagctagattcggtcgccatgttcgtagcttctcggttgattccgatttcttcgatgatttgggtgttactgaggagaagtttatagctacaagttcaggagagaagaagaaagggaatcatcatcatagcaggagtaattctatggatggagagatgagttcggcgtcgtttaatatcgaatcgattttagcttctgtgagtggtaaagatagtgggaagaagaatatgggtatgggtggtgatagacttgctgagcttgctttgcttgatcctaaaagagctaaaaggattttagcgaatagacaatctgcggcgaggtcgaaagagaggaagattaggtatactggtgagttagagaggaaggttcagacacttcagaatgaagctactacattgtctgctcaagtcactatgttacagagaggaacatcagagctgaacactgaaaataaacacctcaaaatgcggcttcaagctttagagcaacaagctgaacttagggatgctttgaatgaagcgctgcgggatgaactgaaccgacttaaggtggtagctggagaaattcctcaggggaatggaaattcttacaaccgtgctcaattctcatctcagcaatcggcaatgaatcagtttgggaacaaaacgaaccaacagatgagtacaaacgggcagccatcgctcccaagctacatggatttcaccaagagaggctga

SEQ ID NO: 2802 - protein, 341 aa, Arabidopsis thaliana
  G2069
MEGGGRGPNQTILSEIEHMPEAPRQRISHHRRARSETFFSGESIDDLLLFDPSDIDFSSLDFLNAPPPPQQSQQQPQASPMSVDSEETSSNGVVPPNSLPPKPEARFGRHVRSFSVDSDFFDDLGVTEEKFIATSSGEKKKGNHHHSRSNSMDGEMSSASFNIESILASVSGKDSGKKNMGMGGDRLAELALLDPKRAKRILANRQSAARSKERKIRYTGELERKVQTLQNEATTLSAQVTMLQRGTSELNTENKHLKMRLQALEQQAELRDALNEALRDELNRLKVVAGEIPQGNGNSYNRAQFSSQQSAMNQFGNKTNQQMSTNGQPSLPSYMDFTKRG

SEQ ID NO: 2803 - DNA, 1099 bp, Arabidopsis thaliana
  G2072
tcgacccacgcgtccgcccacgcgtccggatcttttcacagaagaccaaccagcttggctcgatgagctcctaagtgagccagcatcacctaagattaacaaaggtcatagacgttcagctagtgacacagctgcttacttgaactcagctttaatgccttcgaaggaaaatcatgttgctggttcgtcttggcagttccagaactatgatttgtggcagtccaactcttatgaacaacacaataaattaggatgggatttctctacagcaaatggaactaatatccaaagaaatatgtcatgcggagctttaaatatgtcgtcgaaacccattgagaaacatgtaagcaaaatgaaagaaggaacttctacaaaaccagatggtcctagatcaaagactgactcaaaacgtatcaaacatcaaaatgctcatcgagcgcgtttgagaaggcttgagtacatatcagaccttgaaaggaccatccaagtgctacaagttgaaggatgtgaaatgtcatctgccattcactacttggatcagcagttactcatgcttagcatggaaaatagagctttaaaacaacgtatggatagtttagcagaaatccaaaagcttaaacatgtggagcagcaattgcttgagagagagataggaaacctacagtttcgacgacaccaacaacaaccacagcaaaaccaaaaacaagtccaagcaatacaaaatcgatacaccaaatatcaaccacctgttacacaagaacccgatgcccaatttgcagccttggcaatatgatttaggaaatatggatacattgttcagattaagctgagctcctcttgctctaccttaatgtccatacaacataggtgaacttgatgtttgtagccttgaatgaaaacctaaaaaagcatcgttatgtaaatcaaaatgtggttgcccatatcctcctctattgcatttctctctatttatggcatggtagagaatctcttgtcaagaaacttcatgttatgtaataacttgtaatccttcttatttcatctattatatatatgaataagtaatttttttgccaaaaaaaaaaaaaaaaaaaaaaaa

SEQ ID NO: 2804 - protein, 212 aa, Arabidopsis thaliana
  G2072
MPSKENHVAGSSWQFQNYDLWQSNSYEQHNKLGWDFSTANGTNIQRNMSCGALNMSSKPIEKHVSKMKEGTSTKPDGPRSKTDSKRIKHQNAHRARLRRLEYISDLERTIQVLQVEGCEMSSAIHYLDQQLLMLSMENRALKQRMDSLAEIQKLKHVEQQLLEREIGNLQFRRHQQQPQQNQKQVQAIQNRYTKYQPPVTQEPDAQFAALAI

SEQ ID NO: 2805 - DNA, 450 bp, Arabidopsis thaliana
  G2094
atgctagatcccaccgagaaagtaatcgattcagaatcaatggaaagcaaactcacatcagtagatgcgatcgaagaacacagcagcagtagcagtaatgaagctatcagcaacgagaagaagagttgtgccatttgtggtaccagcaaaacccctctttggcgaggcggtcctgccggtcccaagtcgctttgtaacgcatgcgggatcagaaacagaaagaaaagaagaacactgatctcaaatagatcagaagataagaagaagaagagtcataacagaaacccgaagtttggtgactcgttgaagcagcgattaatggaattggggagagaagtgatgatgcagcgatcaacggctgagaatcaacggcggaataagcttggcgaagaagagcaagccgccgtgttactcatggctctctcttatgcttcttccgtttatgcttaa

SEQ ID NO: 2806 - protein, 149 aa, Arabidopsis thaliana
  G2094
MLDPTEKVIDSESMESKLTSVDAIEEHSSSSSNEAISNEKKSCAICGTSKTPLWRGGPAGPKSLCNACGIRNRKKRRTLISNRSEDKKKKSHNRNPKFGDSLKQRLMELGREVMMQRSTAENQRRNKLGEEEQAAVLLMALSYASSVYA

SEQ ID NO: 2807 - DNA, 722 bp, Arabidopsis thaliana
  G2108
gagagagaaacattgatctctgaatattgtgaacatgttgaaatcaagtaacaagagaaaaagcaaagaagagaagaagttacaagaagggaagtaccttggagtgaggagacgtccatggggaagatatgcagctgaaatcagaaacccttttactaaagaaagacattggcttggaacgtttgatacagccgaagaagctgcttttgcatatgacgttgctgctcgatccatcagcggctctctagctacaacaaacttcttctacactgaaaacacctctttagaaagacatccacaacagtctttggagcctcatatgacttggggatcttctagtctctgtcttcttcaagatcagccttttgaaaacaaccattttgttgctgatcctatctcttcttctttttctcaaaaacaagagtcttctaccaatctcactaacactttctcacattgttataatgatggtgatcatgttggccaaagcaaagagatttctttacctaatgatatgtcaaacagtttattcggtcatcaggacaaagtcggtgaacatgacaatgcagaccatatgaagtttggctcagttctcagcgacgaacctctctgctttgagtatgactacattgggaattatcttcagagttttctcaaagatgtcaacgacgatgctccacagtttcttatgtgagcttgtattaccgatccttcaatttatg

SEQ ID NO: 2808 - protein, 219 aa, Arabidopsis thaliana
  G2108
MLKSSNKRKSKEEKKLQEGKYLGVRRRPWGRYAAEIRNPFTKERHWLGTFDTAEEAAFAYDVAARSISGSLATTNFFYTENTSLERHPQQSLEPHMTWGSSSLCLLQDQPFENNHFVADPISSSFSQKQESSTNLTNTFSHCYNDGDHVGQSKEISLPNDMSNSLFGHQDKVGEHDNADHMKFGSVLSDEPLCFEYDYIGNYLQSFLKDVNDDAPQFLM

SEQ ID NO: 2809 - DNA, 640 bp, Arabidopsis thaliana
  G2113
ataacaaactcatcaaacttcctcagcgtttctttttcttacataaacaatttttcttacataaacaaatcttgttgtttgttgttgtcatggcaccgacagttaaaacggcggccgtcaaaaccaacgaaggtaacggagtccgttacagaggagtgaggaagagaccatggggacgttacgcagccgagatcagagatcctttcaagaagtcacgtgtctggctcggtactttcgacactcctgaagaagccgctcgtgcctacgacaaacgtgctattgagtttcgtggagctaaagccaaaaccaacttcccttgttacaacatcaacgcccactgcttgagtttgacacagagcctgagccagagcagcaccgtggaatcatcgtttcctaatctcaacctcggatctgactctgttagttcgagattcccttttcctaagattcaggttaaggctgggatgatggtgttcgatgaaaggagtgaatcggattcttcgtcggtggtgatggatgtcgttagatatgaaggacgacgtgtggttttggacttggatcttaatttccctcctccacctgagaactgattaagatttaattatgattattagatataattaaatgtttctgaattgag

SEQ ID NO: 2810 - protein, 166 aa, Arabidopsis thaliana
  G2113
MAPTVKTAAVKTNEGNGVRYRGVRKRPWGRYAAEIRDPFKKSRVWLGTFDTPEEAARAYDKRAIEFRGAKAKTNFPCYNINAHCLSLTQSLSQSSTVESSFPNLNLGSDSVSSRFPFPKIQVKAGMMVFDERSESDSSSVVMDVVRYEGRRVVLDLDLNFPPPPEN

SEQ ID NO: 2811 - DNA, 765 bp, Arabidopsis thaliana
  G2115
aatcactctacaaagcctgtacgtacacaacaacattaccatggtgaaacaagaacgcaagatccaaaccagcagcacaaaaaaggaaatgcctttgtcatcatcaccatcttcttcttcttcttcatcttcttcctcgtcttcgtcttcgtgtaagaacaagaacaagaagagtaagattaagaagtacaaaggagtgaggatgagaagttggggatcatgggtctctgagattagggcaccaaatcaaaagacaaggatttggttaggttcttactcaacagctgaagcagctgctagagcttacgatgttgcactcttatgtctcaaaggccctcaagccaatctcaacttccctacttcttcttcttctcatcatcttcttgataatctcttagatgaaaatacccttttgtcccccaaatccatccaaagagtagctgctcaagctgccaactcatttaaccattttgcccctacttcatcagccgtctcgtcaccgtccgatcatgatcatcaccatgatgatgggatgcaatctttgatgggatcttttgtggacaatcatgtgtctttgatggattcaacatcttcatggtatgatgatcataatgggatgttcttgtttgataatggagctccattcaattactctcctcaactaaactcgacgacgatgctcgatgaatacttctacgaagatgctgacattccgctttggagtttcaattaatccgacggtccataatacatactttaattagt

SEQ ID NO: 2812 - protein, 230 aa, Arabidopsis thaliana
  G2115
MVKQERKIQTSSTKKEMPLSSSPSSSSSSSSSSSSSSCKNKNKKSKIKKYKGVRMRSWGSWVSEIRAPNQKTRIWLGSYSTAEAAARAYDVALLCLKGPQANLNFPTSSSSHHLLDNLLDENTLLSPKSIQRVAAQAANSFNHFAPTSSAVSSPSDHDHHHDDGMQSLMGSFVDNHVSLMDSTSSWYDDHNGMFLFDNGAPFNYSPQLNSTTMLDEYFYEDADIPLWSFN

SEQ ID NO: 2813 - DNA, 1148 bp, Arabidopsis thaliana
  G2116
ttcatctccatcattatctccattgacattgttctcaattgcgaataataatcataattattcacacaaccaaagcattcatctctcagattctcttaaaaaaatggagaaatcagatcctccaccagtcccaaagcccggcgccactattatcccctcctccgatccaattcctaatgccgatccgattccatcttcttccttccaccgccgatctcgctccgacgatatgtccatgttcatgttcatggatcccctctcctccgccgcaccaccttcctccgacgaccttccctccgacgacgatctcttctcttctttcatcgatgtcgatagcctcacctctaatcccaatccctttcaaaatccttccctctcctccaactccgtttccggcgctgctaatcctcctcctcctccttcctctcgtcctcgccaccgtcacagcaattccgttgacgctggatgcgccatgtatgccggtgatatcatggacgctaagaaagctatgcctcctgaaaaactctctgagctttggaacatcgatcccaaacgcgccaaaaggattctagcgaatcgacaatctgcagctcgatccaaagagagaaaagctcgatacattcaagaacttgagcgcaaagttcaatctcttcaaaccgaagctaccactctctctgctcagcttactctctaccagagagacacaaatggactagcaaacgaaaacacagagctgaaacttaggttgcaagcaatggaacaacaagctcagcttcgtaatgctttaaacgaagcgttgaggaaagaagttgaaaggatgaagatggagacaggagaaatctctggtaattcagattcgtttgatatgggaatgcagcagattcagtattcttcctcaactttcatggctattccaccatatcatggctcaatgaacctccatgatatgcagatgcattctagtttcaatcctatggagatgtccaattctcaaagcgtgtcggactttctacagaacggccgaatgcaagggctggagattagtagcaatagctcaagcttagtcaaatctgaaggaccttctctctctgctagtgagagtagctctgcctattgacgacaagattatgatgaggctcatttttctg

SEQ ID NO: 2814 - protein, 337 aa, Arabidopsis thaliana
  G2116
MEKSDPPPVPKPGATIIPSSDPIPNADPIPSSSFHRRSRSDDMSMFMFMDPLSSAAPPSSDDLPSDDDLFSSFIDVDSLTSNPNPFQNPSLSSNSVSGAANPPPPPSSRPRHRHSNSVDAGCAMYAGDIMDAKKAMPPEKLSELWNIDPKRAKRILANRQSAARSKERKARYIQELERKVQSLQTEATTLSAQLTLYQRDTNGLANENTELKLRLQAMEQQAQLRNALNEALRKEVERMKMETGEISGNSDSFDMGMQQIQYSSSTFMAIPPYHGSMNLHDMQMHSSFNPMEMSNSQSVSDFLQNGRMQGLEISSNSSSLVKSEGPSLSASESSSAY

SEQ ID NO: 2815 - DNA, 1120 bp, Arabidopsis thaliana
  G2124
gaacagcaaaaccctagatttcctgttcaagctcaagaccgtacaaaactttggaactcatatataaagatctcgagaatagcattatgaatatcgtctcttggaaagatgcaaacgacgaagttgcaggcggcgctacgacaagacgtgaaagagaagtaaaagaggatcaagaagaaaccgaagtcagagccaccagtggcaaaaccgtaattaaaaagcagcctacatcgatctcttcttcttcttcttcgtggatgaaatccaaggatccgaggattgttagggtttcacgcgcctttggaggcaaagaccgtcacagcaaagtgtgtacgttacgtggactacgtgacagacgcgtgagattatcagtcccaacggctattcagctctacgatcttcaagaacggctcggtgttgaccagcctagcaaagccgttgactggttgcttgatgcagctaaagaggagatcgacgagctacctccgttacctatctcgccggaaaatttcagcatcttcaaccatcatcagtccttcttgaatcttggtcaacggcccggtcaagatccgacccaactcgggtttaaaatcaatggatgtgtacaaaagtctactactactagccgcgaagaaaacgatagagagaaaggagaaaacgatgtcgtttacacaaacaatcatcatgttgggtcttatggaacttatcacaacctggaacatcatcatcatcatcaccaacatttgagtttacaggcagattatcatagtcatcaactacatagtcttgtcccatttccatcacaaattttggtatgtccaatgacgacatcaccaacaactacaactatacaatctttgtttccatcatcatcgtcagctggttcagggactatggagacattagatccgaggcaaatgtagcaacaatggtggtagagacattgataatcggatgtcgtcggtccaattcaaccgaactaatagcactacaacggctaacatgtcgaggcatctaggctcggagcgttgtacaagtagaggaagtgatcaccatatgtgaagttagattattgaaacgatataattgttgtttgatgtgttcagaaataaggggacac

SEQ ID NO: 2816 - protein, 278 aa, Arabidopsis thaliana
  G2124
MNIVSWKDANDEVAGGATTRREREVKEDQEETEVRATSGKTVIKKQPTSISSSSSSWMKSKDPRIVRVSRAFGGKDRHSKVCTLRGLRDRRVRLSVPTAIQLYDLQERLGVDQPSKAVDWLLDAAKEEIDELPPLPISPENFSIFNHHQSFLNLGQRPGQDPTQLGFKINGCVQKSTTTSREENDREKGENDVVYTNNHHVGSYGTYHNLEHHHHHHQHLSLQADYHSHQLHSLVPFPSQILVCPMTTSPTTTTIQSLFPSSSSAGSGTMETLDPRQM

SEQ ID NO: 2817 - DNA, 1064 bp, Arabidopsis thaliana
  G2132
attctgttacttagtaccggagtttagtcggagagagaacaatgatcagtttcagagaagagaacatcgatctcaacttgattaaaacaattagtgtaatctgtaatgatccagacgccaccgattcctctagcgacgatgaatctatctccggcaataatcctcgccgtcagatcaaaccaaaaccaccgaaacgttacgtctcaaagatctgtgtcccgacgctgatcaaaaggtatgagaacgtttcgaattctacagggaataaagcagccggaaaccggaaaacgtcgtcgggtttcaaaggcgtacgacggaggccgtgggggaaatttgcggcggagataagaaatccgtttgagaagaagagaaagtggcttggaacgtttcctactgaagaagaagcagcagaagcttaccaaaagagtaaaagagagtttgatgaacgattgggtttagttaaacaggaaaaagacctagtagatttgaccaagccgtgcggtgtacgtaaaccagaagagaaggaagttactgagaagtcgaattgcaaaaaggtaaataagagaattgttactgatcagaagccatttggttgtggttataacgctgatcatgaagaagagggagtgattagtaaaatgttggaagatccgttgatgacatcgtcaattgctgatatttttggtgattcggctgttgaagcaaatgatatttgggtggattacaattcagtggaatttatttccattgtagatgatttcaagtttgattttgtggagaatgatagagtaggaaaggagaaaacatttggatttaagattggggatcacactaaagttaatcaacatgccaaaatcgtatcgaccaatggggacttattcgtcgatgatttacttgattttgatccgttgatagatgattttaagttagaagattttcctatggatgatcttggattattaggagatccagaggatgatgattttagttggtttaatggtactactgattggatcgataagtttttatgaatactttcttgacacggccaacggtattagtac

SEQ ID NO: 2818 - protein, 329 aa, Arabidopsis thaliana
  G2132
MISFREENIDLNLIKTISVICNDPDATDSSSDDESISGNNPRRQIKPKPPKRYVSKICVPTLIKRYENVSNSTGNKAAGNRKTSSGFKGVRRRPWGKFAAEIRNPFEKKRKWLGTFPTEEEAAEAYQKSKREFDERLGLVKQEKDLVDLTKPCGVRKPEEKEVTEKSNCKKVNKRIVTDQKPFGCGYNADHEEEGVISKMLEDPLMTSSIADIFGDSAVEANDIWVDYNSVEFISIVDDFKFDFVENDRVGKEKTFGFKIGDHTKVNQHAKIVSTNGDLFVDDLLDFDPLIDDFKLEDFPMDDLGLLGDPEDDDFSWFNGTTDWIDKFL

SEQ ID NO: 2819 - DNA, 904 bp, Arabidopsis thaliana
  G2134
gagcaaaaactttgtgtgcgtgtgtgtgtgtgttcatggctggtcttaggaattccggtaacagcgacaaagcgcaaaacgatggcaaaggtgtaccatctgcctacagaggagtccggaagagaaaatgggggaaatgggtgtctgaaatccgtgaaccggggaccaagaaccgtatctggctaggcagtttcgagactcctgaaatggctgcaaccgcatacgacgtggcagcatttcatttcagagggagagaagctcgtctcaacttccctgagctcgccagcagccttccacgtcctgcagactctagctcagacagcattcgcatggcagttcatgaggcaacactctgccgcaccaccgaaggaacagagtcagccatgcaagtggacagctcaagctcctccaatgtagctccaacaatggtcagactctcgcccagggaaattcaagcgatcaacgagtcaactttgggatctcctactacaatgatgcattcaacatacgaccctatggagtttgctaatgatgtggagatgaatgcttgggaaacataccagagtgactttctttgggacccttaaccccaaaacctaactcatggagagcttctacagctcaatcttacaataccagcataagttactggcttagaatacttaaatttattgaagtttagttttcagagtctaccacaagggttgttgattctgacgttatagcaaagaataaagctcatcagattttggagggaaagactctatgagcttgatgggtccctgaaaggacctcttcacaaatatttttaaatttttttgttactagtagaaacatagattatgaggtgtgacttattattattttttacaattgtttgttacctcattgatgtatttgattt

SEQ ID NO: 2820 - protein, 183 aa, Arabidopsis thaliana
  G2134
MAGLRNSGNSDKAQNDGKGVPSAYRGVRKRKWGKWVSEIREPGTKNRIWLGSFETPEMAATAYDVAAFHFRGREARLNFPELASSLPRPADSSSDSIRMAVHEATLCRTTEGTESAMQVDSSSSSNVAPTMVRLSPREIQAINESTLGSPTTMMHSTYDPMEFANDVEMNAWETYQSDFLWDP

SEQ ID NO: 2821 - DNA, 739 bp, Arabidopsis thaliana
  G2136
acaaaaatctcttgttcttcttgtcttcaatatggaggatggggaagcttcaacaatcactttcttaccaaccacggaaccaaaacccctacaaaaccctaacttgctggccaaaccaaaaaaagagactaaacaaaaaaaacctaaaaccaccaaaggtcgacagaagatagagatcaaggagatcatgctggagacccgaaggcaagtgacgttttccaaacgacgatccgggcttttcaaaaaagcggcagaattaagcgttctctgcggcgcacagattggtatcataacgttttcacgttgcgataggatctactcgtttggtaacgtgaactcactcatcgataaatacttgcgtaaggctccggtgatgctgaggtcacatcccggtggtaacgtggcaaacggagaggaagataacgacggtttgatgtggtgggagagagcggtggagagtgtgccggaggagcatatggaagagtacaagaatgccttgagtgtgttaagggagaatttgttgacgaggatctaccagatgagtggtgatcggacggttgagaatcttccggcatttccaaatgagatggctatggctgactggaaattaacgaatgaaaatctgatggctaggaacgatcgaggttatggaggtaacaatggtgatttggagtttgcgtttatgcctcaaaacggtagacagtgaggtgttttttctttaatttattattacagtttg

SEQ ID NO: 2822 - protein, 224 aa, Arabidopsis thaliana
  G2136
MEDGEASTITFLPTTEPKPLQNPNLLAKPKKETKQKKPKTTKGRQKIEIKEIMLETRRQVTFSKRRSGLFKKAAELSVLCGAQIGIITFSRCDRIYSFGNVNSLIDKYLRKAPVMLRSHPGGNVANGEEDNDGLMWWERAVESVPEEHMEEYKNALSVLRENLLTRIYQMSGDRTVENLPAFPNEMAMADWKLTNENLMARNDRGYGGNNGDLEFAFMPQNGRQ

SEQ ID NO: 2823 - DNA, 1225 bp, Arabidopsis thaliana
  G2137
gggatttgactttagcacttcaaaatccaaagctaaaagacaaaaaagaatagaggttcgatttgcatctccattaatgggcatcgatctttctcttaagctcgaggccgaggagaaaaagaaagagatagaaggatcgaaacatagccgtgagaacaaagaagacgaagaacatgatgctagtggtgatgaagatgaacaaatggtgaaagaagacgaagatgattcttcttctttaggtttaagaacccgagaagaagaaaacgaacgtgaagagctcttgcagctacagatccagatggaaagtgtgaaagaagagaatactaggttgaggaagcttgtcgagcagactcttgaagattatcgtcatcttgagatgaaattcccggttatcgataaaaccaagaagatggatcttgaaatgttccttggagtacaaggcaaacgatgtgtggatataacaagtaaggctcggaaaagaggagctgagagatctccgtcaatggaaagagaaatagggctttcactttctctagagaaaaaacagaaacaagaagagagcaaagaagctgttcagtctcatcaccaaagatacaatagtagcagcttagatatgaatatgccacgtatcatttcatcttctcaaggtaatagaaaggccagggtgtccgtgagggcgagatgtgagaccgcaacaatgaatgatggatgccaatggaggaagtacggtcagaaaaccgcgaaagggaatccatgtcctcgagcttattaccgatgcaccgtggctccaggatgtcccgttagaaaacaggtgcaaaggtgtttagaagacatgtcaatactgataacaacctacgaaggaacacataaccatccacttccggtcggagcaacagccatggcttccactgcctctacttctccattcttgttactcgattccagtgacaacctctctcatccttcctattaccaaactcctcaagccatagactcttctttgattacatacccacaaaatagcagctacaacaatcgaaccataagaagcttgaactttgatggtccatctagaggagatcacgtttcatcttctcaaaaccgattaaattggatgatgtagagtttcctatatctctatgcttgttctttggtcccattatttgtcattatggattctttgcctttcttcttgttctcgtttctaacatttatgtttcgtata

SEQ ID NO: 2824 - protein, 348 aa, Arabidopsis thaliana
  G2137
MGIDLSLKLEAEEKKKEIEGSKHSRENKEDEEHDASGDEDEQMVKEDEDDSSSLGLRTREEENEREELLQLQIQMESVKEENTRLRKLVEQTLEDYRHLEMKFPVIDKTKKMDLEMFLGVQGKRCVDITSKARKRGAERSPSMEREIGLSLSLEKKQKQEESKEAVQSHHQRYNSSSLDMNMPRIISSSQGNRKARVSVRARCETATMNDGCQWRKYGQKTAKGNPCPRAYYRCTVAPGCPVRKQVQRCLEDMSILITTYEGTHNHPLPVGATAMASTASTSPFLLLDSSDNLSHPSYYQTPQAIDSSLITYPQNSSYNNRTIRSLNFDGPSRGDHVSSSQNRLNWMM

SEQ ID NO: 2825 - DNA, 828 bp, Arabidopsis thaliana
  G2139
cctacaagaaatcaaacactagttctggtttctgcaaacatgtcatctacgaagcaagcaaagggaagaaaaacaaaggggaagcaaaagatcgagatgaagaaggtggagaactatggagataggatgattacgttctcaaaacgtaaaaccggaatttttaagaaaatgaacgagctcgtagcaatgtgtgacgttgaagtggctttcttgattttctctcaacccaagaagccctatacattcgcacatccgtctatgaagaaagtggctgaccggttaaagaacccttcgagacaagaaccattagagagagacgataccagacccctcgtcgaagcttataagaaacgaaggctccacgacctcgtaaaaaaaatggaggcgctcgaagaggagcttgcgatggatctagagaagttgaaactgttgaaggaatcgagaaatgaaaagaagttagataaaatgtggtggaactttccttcggaaggtttgagcgcgaaggagctgcagcaaaggtaccaagcgatgctcgagttacgtgataacttatgcgacaatatggctcacttacgattgggaaaagactgtggtggttcatcttctgttcgtgtgggacgtcgagtttctggtggtgttcgtctgttcgatcgtgaagcatgatcatacatattcatacttgatgatttaaatttctttgtatttgaactgctgattttaatactgcatgtatccatttgacgaagctcaatcgtctcgagtatatctctattatctaacagtattgagaaaaaaggagtttcagtaaaaaaaaaaaaaaaaaaaaaa

SEQ ID NO: 2826 - protein, 207 aa, Arabidopsis thaliana
  G2139
MSSTKQAKGRKTKGKQKIEMKKVENYGDRMITFSKRKTGIFKKMNELVAMCDVEVAFLIFSQPKKPYTFAHPSMKKVADRLKNPSRQEPLERDDTRPLVEAYKKRRLHDLVKKMEALEEELAMDLEKLKLLKESRNEKKLDKMWWNFPSEGLSAKELQQRYQAMLELRDNLCDNMAHLRLGKDCGGSSSVRVGRRVSGGVRLFDREA

SEQ ID NO: 2827 - DNA, 777 bp, Arabidopsis thaliana
  G2145
atggacgtttttgttgatggtgaattggagtctctcttggggatgttcaactttgatcaatgttcatcatctaaagaggagagaccgcgagacgagttgcttggcctctctagcctttacaatggtcatcttcatcaacatcaacaccataacaatgtcttatcttctgatcatcatgctttcttgctccctgatatgttcccatttggtgcaatgccgggaggaaatcttccggccatgcttgattcttgggatcaaagtcatcacctccaagaaacgtcttctcttaagaggaaactacttgacgtggagaatctatgcaaaactaactctaactgtgacgtcacaagacaagagcttgcgaaatccaagaaaaaacagagggtaagctcggaaagcaatacagttgacgagagcaacactaattgggtagatggtcagagtttaagcaacagttcagatgatgagaaagcttcggtcacaagtgttaaaggcaaaactagagccaccaaagggacagccactgatcctcaaagcctttatgctcggaaacgaagagagaagattaacgaaaggctcaagacactacaaaaccttgtgccaaacgggacaaaagtcgatataagcacgatgcttgaagaagcggtccattacgtgaagttcttgcagcttcagattaagttgttgagctcggatgatctatggatgtacgcaccattggcttacaacggcctggacatggggttccatcacaaccttttgtctcggcttatgtga

SEQ ID NO: 2828 - protein, 258 aa, Arabidopsis thaliana
  G2145
MDVFVDGELESLLGMFNFDQCSSSKEERPRDELLGLSSLYNGHLHQHQHHNNVLSSDHHAFLLPDMFPFGAMPGGNLPAMLDSWDQSHHLQETSSLKRKLLDVENLCKTNSNCDVTRQELAKSKKKQRVSSESNTVDESNTNWVDGQSLSNSSDDEKASVTSVKGKTRATKGTATDPQSLYARKRREKINERLKTLQNLVPNGTKVDISTMLEEAVHYVKFLQLQIKLLSSDDLWMYAPLAYNGLDMGFHHNLLSRLM

SEQ ID NO: 2829 - DNA, 1366 bp, Arabidopsis thaliana
  G2147
ctgtgattgtcaagagtttgaacacacaaagaagaaagaagaactcaacatttcaagcaagaagaaagagagaagagagaaggtccaataatagagagaacaaaaaaaaagagagcttaattgtcagtttattctctgcaaacgtgcggcctaagtaacacatgtcgaattatggagttaaagagctcacatgggaaaatgggcaactaaccgttcatggtctaggcgacgaagtagaaccaaccacctcgaataaccctatttggactcaaagtctcaacggttgtgagactttggagtctgtggttcatcaagcggctctacagcagccaagcaagtttcagctgcagagtccgaatggtccaaaccacaattatgagagcaaggatggatcttgttcaagaaaacgcggttatcctcaagaaatggaccgatggttcgctgttcaagaggagagccatagagttggccacagcgtcactgcaagtgcgagtggtaccaatatgtcttgggcgtcttttgaatccggtcggagcttgaagacagctagaaccggagacagagactatttccgctctggatcggaaactcaagatactgaaggagatgaacaagagacaagaggagaagcaggtagatctaatggacgacggggacgagcagcagcgattcacaacgagtccgaaaggagacggcgtgataggataaaccagaggatgagaacacttcagaagctgcttcctactgcaagtaaggcggataaagtctcaatcttggatgatgttatcgaacacttgaaacagctacaagcacaagtacagttcatgagcctaagagccaacttgccacaacaaatgatgattccgcaactacctccaccacagtcagttctcagcatccaacaccaacaacaacaacaacaacagcagcagcagcagcaacaacagcagcaacagtttcagatgtcgttgcttgcaacaatggcaagaatgggaatgggaggtggtggaaatggttatggaggtttagttcctcctcctcctcctccaccaatgatggtccctcctatgggtaacagagactgcaccaacggttcttcagccacattatctgatccatacagcgcctttttcgcacagacaatgaatatggatctctacaataaaatggcagcagctatctatagacaacagtctgatcaaacaacaaaggtaaatatcggcatgccttcaagttcttcgaatcatgagaaaagagattagtctagcgacctagtattattgatccatatatatagttcttgaaagattgttgtatcatgattgtaaaaactgttttgagtatggaaaaagacttgcagataaaa

SEQ ID NO: 2830 - protein, 366 aa, Arabidopsis thaliana
  G2147
MSNYGVKELTWENGQLTVHGLGDEVEPTTSNNPIWTQSLNGCETLESVVHQAALQQPSKFQLQSPNGPNHNYESKDGSCSRKRGYPQEMDRWFAVQEESHRVGHSVTASASGTNMSWASFESGRSLKTARTGDRDYFRSGSETQDTEGDEQETRGEAGRSNGRRGRAAAIHNESERRRRDRINQRMRTLQKLLPTASKADKVSILDDVIEHLKQLQAQVQFMSLRANLPQQMMIPQLPPPQSVLSIQHQQQQQQQQQQQQQQQQQFQMSLLATMARMGMGGGGNGYGGLVPPPPPPPMMVPPMGNRDCTNGSSATLSDPYSAFFAQTMNMDLYNKMAAAIYRQQSDQTTKVNIGMPSSSSNHEKRD

SEQ ID NO: 2831 - DNA, 929 bp, Arabidopsis thaliana
  G2148
gtctctaatataagcttgaacgttgctatatataaatgtaaaggcgaacgcataagaaaagaaaaatggagaatgaagcttttgtagatggtgaattggagtctcttttggggatgttcaactttgatcaatgttcatctaacgaatcgagcttttgcaatgctccaaatgagactgatgttttctcttctgatgatttcttcccatttggtacaattctgcaaagtaactatgcggccgttcttgatggttccaaccaccaaacgaaccgaaatgtcgactcaagacaagatctgttgaaaccaaggaagaagcaaaagttaagctcggaaagcaatttggttaccgagcctaagactgcttggagagatggtcaaagcctaagcagttataatagttcagatgatgaaaaggctttaggtttagtgtctaatacatcaaaaagcctaaaacgcaaagcgaaagccaacagagggatagcttccgatcctcagagcctatacgctaggaaacgaagagaaaggataaacgataggctaaagacattgcagagcctagttcctaatgggacaaaggtcgatataagcacaatgctggaagatgctgtccattacgtgaagttcctgcagcttcaaatcaagctcttgagttcagaagatctatggatgtatgcacctcttgctcacaatggtctgaatatgggactacatcacaatcttttgtctcggcttatttaagacaaaatcattggaataacataacttacagtacttgttttttttctcgttctatattcatgattatggttattttttgtttgagttgttcaatttttctgtctattgcgttctatgaacttgacactctttttgtaattattatatgctaaagacaatttggactaacagcattttaataaaaaaaaaaaa

SEQ ID NO: 2832 - protein, 223 aa, Arabidopsis thaliana
  G2148
MENEAFVDGELESLLGMFNFDQCSSNESSFCNAPNETDVFSSDDFFPFGTILQSNYAAVLDGSNHQTNRNVDSRQDLLKPRKKQKLSSESNLVTEPKTAWRDGQSLSSYNSSDDEKALGLVSNTSKSLKRKAKANRGIASDPQSLYARKRRERINDRLKTLQSLVPNGTKVDISTMLEDAVHYVKFLQLQIKLLSSEDLWMYAPLAHNGLNMGLHHNLLSRLI

SEQ ID NO: 2833 - DNA, 1496 bp, Arabidopsis thaliana
  G2151
ttttttttttagggttcataagaacaaattggattttgagctcacagtataaataacccgactttgattactgggtaattttaaaaccgccattgttgttctctttactacttttgggaattagggtttatgatttctgggtattagattagataaatttgtttcctttttttgttaatcaatttaaaaatctcttatttctgttaaagacttgtaattttggagtttttaatgcatggacggaagagaagcaatggcatttccaggctcgcattctcagtactatcttcaaagaggagcctttactaatctcgcaccttcccaagtcgcgagtgggcttcacgcgccgccgccacatacgggattgaggccaatgtctaaccctaacattcatcaccctcaggctaacaatccaggacctcctttctcggattttggacacaccattcacatgggagtggtctcctctgcttctgatgctgatgtgcaaccgccaccgccaccgccaccaccagaggaaccgatggttaagaggaaacgtggacggccaagaaagtatggagaaccgatggttagtaataagtctagggactcttctccaatgtctgatcctaatgaacctaaacgggccagaggtcgacctcctggaactggaaggaagcaacgcttggctaatcttggtgagtggatgaatacttcagctggacttgcttttgcacctcatgtgatcagcattggagcaggagaagacattgctgcgaaagttttgtcattttcacaacaaagacctcgggctctttgtataatgtcaggcactggaaccatttcttcagtcactctgtgcaaacccggttcaaccgatcgtcacttaacatacgagggaccttttgagattataagttttggtggatcttatttggtgaatgaagaaggtggatccagaagtcgaacaggcggattgagtgtctctctttctcgtcccgatggtagtattattgccggtggagttgacatgcttatcgcagccaaccttgttcaggtggtggcatgtagttttgtatacggagcaagggcaaagactcataataacaataacaagaccatcagacaagaaaaggaaccaaatgaagaggacaacaatagtgaaatggagaccacaccgggtagtgcagctgaaccagcagcatctgcgggtcagcagacgccacagaacttctcttctcagggaataagggggtggcccggttcaggctcaggctctggcagatcacttgacatttgcagaaacccactcactgattttgatttgactcgtggatgatatacactattagtctttgaagcagcagcatacaaaatgtgattgctgtacatatgttattgtagatttctctctgggaatgttgaaatcagacatttaaggattgatactagatctctcagctccttctaacattgttaatgtaacagaaccctcccactttcatgctatttgc

SEQ ID NO: 2834 - protein, 361 aa, Arabidopsis thaliana
  G2151
MDGREAMAFPGSHSQYYLQRGAFTNLAPSQVASGLHAPPPHTGLRPMSNPNIHHPQANNPGPPFSDFGHTIHMGVVSSASDADVQPPPPPPPPEEPMVKRKRGRPRKYGEPMVSNKSRDSSPMSDPNEPKRARGRPPGTGRKQRLANLGEWMNTSAGLAFAPHVISIGAGEDIAAKVLSFSQQRPRALCIMSGTGTISSVTLCKPGSTDRHLTYEGPFEIISFGGSYLVNEEGGSRSRTGGLSVSLSRPDGSIIAGGVDMLIAANLVQVVACSFVYGARAKTHNNNNKTIRQEKEPNEEDNNSEMETTPGSAAEPAASAGQQTPQNFSSQGIRGWPGSGSGSGRSLDICRNPLTDFDLTRG

SEQ ID NO: 2835 - DNA, 1666 bp, Arabidopsis thaliana
  G2154
gcaaaaagaaaaaatgaaaaaaaatccctaactctctctctctagaaattcttatttttgtgcgtatctctctaaaaaggaatggatcctaacgaaagccaccatcaccaccaacaacaacagctccatcacctccaccaacagcaacagcaacagcagcagcagcaacgactcacttctccttacttccaccaccaactacagcaccatcaccaccttccaaccaccgtagcaaccaccgcttctaccggaaacgccgttccatcttccaacaatgggcttttccctccgcagcctcagccacagcaccagcctaatgatgggtcatcttctctcgcggtgtaccctcattcagttccgtcctcggctgtgacggcgccgatggagccggtaaagaggaagaggggtcgaccaagaaagtatgtgacgccggaacaagccctagcggctaagaaattggcgtcttctgcgagtagttcgtctgctaaacagaggcgagagcttgctgctgttaccggtggtacggtatcgactaattccgggtcatccaagaaatctcagcttggttctgtcgggaaaactggacaatgttttactccgcatattgttaatatagctcctggcgaggatgtggtccagaaaattatgatgttcgcaaaccaaagcaagcatgaactatgcgttctttctgcatcaggcactatctctaatgcatccttgcgccaaccggctccatcaggaggcaacttaccatatgagggtcaatacgagattctctcactatctggatcctatatccgaactgaacaaggtggtaaatccggcggccttagcgtttctttatctgcttcagatggtcagatcatcggtggagcgattggtagccatctcacagctgctggcccggttcaggtgattcttggtacgtttcagcttgatagaaagaaggatgccgccgggagtggtgggaaaggggatgcttcaaacagtggaagtcggttaacttctcctgtaagctctggacagttgcttggcatgggtttccctcctggtatggaatctacgggaagaaatccaatgaggggaaacgacgagcaacatgatcatcatcatcatcaagccggtttgggtggacctcatcatttcatgatgcaagcgccgcaggggatacacatgacacattccaggccatctgaatggcgcggaggaggcaacagcggtcatgatggcagaggcggtggcgggtatgatttgtcaggaaggataggacatgagtcgtcggagaatggagattacgagcagcaaataccggattagcagagcttccaggagaagtgtgtagagtttagatcccaagtagagaaacagaaggcgagcaaagaatctgaactgagagaggacttattagacagagactcgtctgaagggtctttaatcatagaaagaagttgctgagtgattgcttttgttcttcttcttggtacggtgtattatattaactccacaaccttttttttatactttcagtaacgattctccttcactttcaatttcattccttttttttatactctttttcttttcttataatattttttttggtttttctttcgtttgttactaaaaaaggaaatgctctttttgtgaaatatatacacttcgtttg

SEQ ID NO: 2836 - protein, 411 aa, Arabidopsis thaliana
  G2154
MDPNESHHHHQQQQLHHLHQQQQQQQQQQRLTSPYFHHQLQHHHHLPTTVATTASTGNAVPSSNNGLFPPQPQPQHQPNDGSSSLAVYPHSVPSSAVTAPMEPVKRKRGRPRKYVTPEQALAAKKLASSASSSSAKQRRELAAVTGGTVSTNSGSSKKSQLGSVGKTGQCFTPHIVNIAPGEDVVQKIMMFANQSKHELCVLSASGTISNASLRQPAPSGGNLPYEGQYEILSLSGSYIRTEQGGKSGGLSVSLSASDGQIIGGAIGSHLTAAGPVQVILGTFQLDRKKDAAGSGGKGDASNSGSRLTSPVSSGQLLGMGFPPGMESTGRNPMRGNDEQHDHHHHQAGLGGPHHFMMQAPQGIHMTHSRPSEWRGGGNSGHDGRGGGGYDLSGRIGHESSENGDYEQQIPD

SEQ ID NO: 2837 - DNA, 1440 bp, Arabidopsis thaliana
  G2180
atggctcctgtctcgttacctccaggtttccgattccatccaacagacgaggaactaattacttactatctaaaaagaaagatcaacggtctagaaatcgaacttgaagttatcgctgaagttgatctttacaagtgtgagccatgggacttaccagggaagtccttgcttccgagcaaagaccaagaatggtacttcttcagcccacgagaccggaagtatcccaacggctcaaggacaaaccgggcaactaaaggcggttattggaaggctacaggtaaagaccgccgagttagttggagagaccgagccataggaaccaagaagacattggtttactaccgtgggcgcgcgccacatggcataagaactggttgggtcatgcacgaatatcgacttgatgaaacagaatgtgagccttctgcatacggcatgcaggacgcatatgcactttgtcgtgtgttcaaaaagattgttattgaagctaagccaagagatcaacatcggtcatatgtccacgcgatgtcgaatgtgagtggtaattgctcatcgagttttgacacttgttcggatctcgaaatcagttcaactactcatcaagttcaaaacacattccaaccgcgatttggcaacgagcgatttaactccaacgcaatcagcaacgaggattggtcacaatactacggttcttcttatagaccgttccctactccatataaggttaacacagagatcgaatgttcaatgttacaacacaatatatatctaccaccgttgcgtgtagagaactctgcgtttagtgattccgatttcttcacgagtatgactcacaacaacgaccatggcgttttcgatgactttacttttgctgcaagtaactccaaccacaataatagcgttggtgatcaagtgatccacgttggcaattatgatgaacaattaataacatctaaccgtcatatgaaccagactggttatataaaagagcagaagatcagatcgagtttggataatactgacgaagatccaggatttcatggtaacaataccaatgacaacatagatatcgatgattttctctcgtttgatatatataacgaggacaacgtgaatcaaatagaagataatgaagacgtgaatacaaatgaaacccttgattcatcgggattcgaggtggttgaagaagaaactagatttaacaaccaaatgctcatctcgacatatcaaacgacaaagattctatatcaccaagtcgtaccttgtcacacgttgaaagttcacgtcaatcctattagtcacaatgtggaagagagaacattgttcattgaagaggacaaagattcttggttacaaagagctgagaagatcacgaagacaaaactaacactttttagtttaatggctcagcaatactacaaatgtcttgctatttttttctga

SEQ ID NO: 2838 - protein, 479 aa, Arabidopsis thaliana
  G2180
MAPVSLPPGFRFHPTDEELITYYLKRKINGLEIELEVIAEVDLYKCEPWDLPGKSLLPSKDQEWYFFSPRDRKYPNGSRTNRATKGGYWKATGKDRRVSWRDRAIGTKKTLVYYRGRAPHGIRTGWVMHEYRLDETECEPSAYGMQDAYALCRVFKKIVIEAKPRDQHRSYVHAMSNVSGNCSSSFDTCSDLEISSTTHQVQNTFQPRFGNERFNSNAISNEDWSQYYGSSYRPFPTPYKVNTEIECSMLQHNIYLPPLRVENSAFSDSDFFTSMTHNNDHGVFDDFTFAASNSNHNNSVGDQVIHVGNYDEQLITSNRHMNQTGYIKEQKIRSSLDNTDEDPGFHGNNTNDNIDIDDFLSFDIYNEDNVNQIEDNEDVNTNETLDSSGFEVVEEETRFNNQMLISTYQTTKILYHQVVPCHTLKVHVNPISHNVEERTLFIEEDKDSWLQRAEKITKTKLTLFSLMAQQYYKCLAIFF

SEQ ID NO: 2839 - DNA, 1005 bp, Arabidopsis thaliana
  G2181
atgatgcttgcggtggaagatgtgttaagcgaactcgccggagaagaaaggaacgagagaggattgccacctggcttccggtttcacccgacggacgaagagctcattaccttctacttagcttccaaaatcttccatggtggtctctccggcattcacatttccgaagttgatctcaaccgctgtgaaccttgggagctaccagaaatggcgaagatgggagagagagagtggtacttttatagtctaagggacaggaaatatccgacaggtttgaggactaacagagcaactactgctggatactggaaagctaccggcaaagataaggaagtcttctccggcggaggaggacagcttgttgggatgaagaagacgttggtgttctacaaaggtagggctccacgtggcctcaagactaagtgggtcatgcatgagtatcgcctcgaaaacgaccattcacaccgccacacgtgtaaggaggaatgggtgatttgcagagtgttcaataaaacaggagacagaaaaaatgttggattaatccataaccaaatcagctaccttcataaccattcactctcaacaacacatcatcatcatcatgaagccttacctttgcttatagaaccttccaacaaaaccctaaccaacttcccatcactactctacgatgatccacaccaaaactacaataataacaacttccttcatggatcatcaggccacaacatcgacgagctcaaagccttaatcaaccctgtcgtctctcagctcaacggtatcatctttccttcagggaacaacaacaacgacgaagacgacttcgactttaacctcggcgtgaaaacagagcagtcttcgaacggtaacgaaattgacgtacgagattacttggagaaccctctgtttcaggaagcgagttatggtctgttgggtttttcgtcttctcctggacctcttcacatgctactagattctccatgtcctttaggattccagctgtag

SEQ ID NO: 2840 - protein, 334 aa, Arabidopsis thaliana
  G2181
MMLAVEDVLSELAGEERNERGLPPGFRFHPTDEELITFYLASKIFHGGLSGIHISEVDLNRCEPWELPEMAKMGEREWYFYSLRDRKYPTGLRTNRATTAGYWKATGKDKEVFSGGGGQLVGMKKTLVFYKGRAPRGLKTKWVMHEYRLENDHSHRHTCKEEWVICRVFNKTGDRKNVGLIHNQISYLHNHSLSTTHHHHHEALPLLIEPSNKTLTNFPSLLYDDPHQNYNNNNFLHGSSGHNIDELKALINPVVSQLNGIIFPSGNNNNDEDDFDFNLGVKTEQSSNGNEIDVRDYLENPLFQEASYGLLGFSSSPGPLHMLLDSPCPLGFQL

SEQ ID NO: 2841 - DNA, 1312 bp, Arabidopsis thaliana
  G2290
ttctttctttctttctttctcttccaatcaagaacaaaccctagctcctctctttttctctctctacctctctttctctatcttctcttatcactacttctctcgccgatcaatcatcatgaacgatcctgataatcccgatctgagcaacgacgactctgcttggagagaactcacactcacagctcaagattctgacttcttcgaccgagacacttccaatatcctctctgacttcggttggaacctccaccactcctccgatcatcctcacagtctcagattcgactccgatttaacacaaaccaccggagtcaaacctaccaccgtcacttcttcttgttcctcatccgccgccgtttccgttgccgttacctctactaataataatccctcagctacctcaagttcaagtgaagatccggccgagaactcaaccgcctccgccgagaaaacaccaccaccggagacaccagtgaaggagaagaagaaggctcaaaagcgaattcggcaaccaagattcgcattcatgaccaagagtgatgtggataatcttgaagatggatatcgatggcgtaaatatggacaaaaagccgtcaagaatagcccattcccaaggagctactatagatgcacaaacagcagatgcacggtgaagaagagagtagaacgttcatcagatgatccatcgatagtgatcacaacatacgaaggacaacattgccatcaaaccattggattccctcgtggtggaatcctcactgcacacgacccacatagcttcacttctcatcatcatctccctcctccattaccaaatccttattattaccaagaactccttcatcaacttcacagagacaataatgctccttcaccgcggttaccccgacctactactgaagatacacctgccgtgtctactccatcagaggaaggcttacttggtgatattgtacctcaaactatgcgcaacccttgaggtaagcttggtacgtagcaatagctaaggaggtgctaactcattatatatagaagatattgcagaccagaatatgcgcagggagggtataacaatatggcgttgtaacaatggatctatatattacctcattgttgatcaatagcacaccaccggtacgtttgcaatttcttcatgtatatttcttgttatatatgtagttatatatccaggtataattttgatgtaacacaacattaatcttaatcgtggatccatcccacatttgatgcatgtatgtgcacttaagaaaaagaacatggaggaaataacgttattttttattattct

SEQ ID NO: 2842 - protein, 287 aa, Arabidopsis thaliana
  G2290
MNDPDNPDLSNDDSAWRELTLTAQDSDFFDRDTSNILSDFGWNLHHSSDHPHSLRFDSDLTQTTGVKPTTVTSSCSSSAAVSVAVTSTNNNPSATSSSSEDPAENSTASAEKTPPPETPVKEKKKAQKRIRQPRFAFMTKSDVDNLEDGYRWRKYGQKAVKNSPFPRSYYRCTNSRCTVKKRVERSSDDPSIVITTYEGQHCHQTIGFPRGGILTAHDPHSFTSHHHLPPPLPNPYYYQELLHQLHRDNNAPSPRLPRPTTEDTPAVSTPSEEGLLGDIVPQTMRNP

SEQ ID NO: 2843 - DNA, 827 bp, Arabidopsis thaliana
  G2291
gctttctcacctttataaaatagaaaatggaaaacagctacaccgttgatggtcaccgtcttcaatattccgttccgttaagctccatgcatgaaaccagtcaaaactccgaaacttacggattatccaaagagtcgccgttggtctgcatgcccttgttcgaaaccaacactacttcattcgatatctcttctcttttctcgtttaacccaaaaccagaacccgaaaacacgcatcgtgtcatggacgattccatcgccgccgtcgtgggcgaaaacgttcttttcggtgataaaaacaaagtctctgatcacttgaccaaagaaggtggtgtgaagcgggggcggaagatgccgcagaagaccggaggattcatgggagtgagaaaacggccgtgggggagatggtcggcggagataagagacaggatagggcggtgcagacactggttaggaacgttcgacacggcggaagaggcagcgcgtgcgtatgacgcggcggcgaggaggcttagagggaccaaagccaagaccaatttcgtgattcctccgctttttcccaaggaaatagctcaggctcaggaggataataggatgaggcagaagcagaagaagaagaagaagaaaaaagtgagtgtgaggaagtgtgttaaagtcacatcggttgcacagttgttcgatgatgccaattttataaattcttctagtattaaaggaaatgtgattagttctattgataatcttgaaaaaatgggtctagagcttgatttgagtttagggttgttgtctaggaagtgataaagcactcgtagttaagtagttgtagtt

SEQ ID NO: 2844 - protein, 256 aa, Arabidopsis thaliana
  G2291
MENSYTVDGHRLQYSVPLSSMHETSQNSETYGLSKESPLVCMPLFETNTTSFDISSLFSFNPKPEPENTHRVMDDSIAAVVGENVLFGDKNKVSDHLTKEGGVKRGRKMPQKTGGFMGVRKRPWGRWSAEIRDRIGRCRHWLGTFDTAEEAARAYDAAARRLRGTKAKTNFVIPPLFPKEIAQAQEDNRMRQKQKKKKKKKVSVRKCVKVTSVAQLFDDANFINSSSIKGNVISSIDNLEKMGLELDLSLGLLSRK

SEQ ID NO: 2845 - DNA, 687 bp, Arabidopsis thaliana
  G2294
tcctcccttaattagtatcaaaaatggtgaaaacacttcaaaagacaccaaagagaatgtcatctccatcatcatcatcttcatcatcctcatcaacatcatcatcatccataaggatgaagaagtacaagggagtgagaatgagaagttggggttcatgggtttcagagatcagagctcctaatcaaaagacaaggatctggcttggttcttactcaactgctgaagccgcggctagagcctacgacgcagcactcctatgtcttaaaggatcctcagctaataatctcaacttcccagagatctcaacttctctctaccatattatcaacaatggtgataacaacaatgacatgtcccctaagtctatacaaagagtagcagctgcagctgctgctgccaacacagatccttcctcatcatcagtctctacttcatctccattgctttcctctccatctgaagatctctatgatgttgtctccatgtcacagtatgaccaacaagtctccttgtctgaatcatcatcatggtacaactgctttgatggtgatgatcagttcatgttcattaatggagtctccgcgccgtatttgacaacatcactttctgatgatttctttgaggaaggagatatcagattatggaacttctgctgattctactttcattataccttattctttg

SEQ ID NO: 2846 - protein, 211 aa, Arabidopsis thaliana
  G2294
MVKTLQKTPKRMSSPSSSSSSSSSTSSSSIRMKKYKGVRMRSWGSWVSEIRAPNQKTRIWLGSYSTAEAAARAYDAALLCLKGSSANNLNFPEISTSLYHIINNGDNNNDMSPKSIQRVAAAAAAANTDPSSSSVSTSSPLLSSPSEDLYDVVSMSQYDQQVSLSESSSWYNCFDGDDQFMFINGVSAPYLTTSLSDDFFEEGDIRLWNFC

SEQ ID NO: 2847 - DNA, 1067 bp, Arabidopsis thaliana
  G2299
gccaaaattttaccaacatttttctcttctcatatcaaagtttctctctcatttcttcatcacacttcactgccctgttttttttcctcattttgaatagttctcaaacttatatatttttccccctgaagcctagctatttctttttatttgcattaatctcgggatccgaatcgaaaaaagcaatcagaataatagacttgtacgatacttgtgcctaagctaacacaatggcagaggaatactacagcctccgctcggagagagtaactcagcttcttgtccctaactcggagtctgactcagtgagtgacaaaagcaaagctgagcaaagcgagaagaagactaaacgtgggagagactccggtaaacaccctgtttatcgcggagtaaggatgaggaactggggaaaatgggtgtcggagattcgtgagccgaggaagaaatcacgtatttggctgggaactttcccgacgccggagatggcggcgcgtgcacacgacgtggcggctctgagcattaaaggaacggccgctatactaaacttccctgaactcgctgactcattccctcgacccgtttcattaagccctcgagacattcagacagcagctcttaaagcagctcacatggaaccgacgacgtcgttttcatcttccacgtcttcgtcgtcgtctttgtcttctacgtcttcgctcgagtctcttgtgttggtgatggacctctcgaggactgagtcggaggagctcggtgagattgtggagcttccaagtctcggggcgagttacgacgtcgactcggctaaccttgggaacgagtttgtcttctatgactcagttgactactgtttatatccgccgccgtggggacagtcgtccgaagataactatggtcacggaattagccctaattttggccatggcttgtcatgggatctctaacagtttattttgtatcattaccataatgttttgtttaaaacagtttattttgtatcattgccataatgttttgtttaatcacgtttttaaaaccctttgctgtttttgttttttttttgagttttt

SEQ ID NO: 2848 - protein, 236 aa, Arabidopsis thaliana
  G2299
MAEEYYSLRSERVTQLLVPNSESDSVSDKSKAEQSEKKTKRGRDSGKHPVYRGVRMRNWGKWVSEIREPRKKSRIWLGTFPTPEMAARAHDVAALSIKGTAAILNFPELADSFPRPVSLSPRDIQTAALKAAHMEPTTSFSSSTSSSSSLSSTSSLESLVLVMDLSRTESEELGEIVELPSLGASYDVDSANLGNEFVFYDSVDYCLYPPPWGQSSEDNYGHGISPNFGHGLSWDL

SEQ ID NO: 2849 - DNA, 755 bp, Arabidopsis thaliana
  G2313
cgtcgacacaatcgctcttccgtaacatattccacaaaacgatcttcttgtttcttgaatttttagccatctcttttttttttttctcattttctcggatactatggcttcgagtccacgctggacggaggacgacaacaggcgttttaagtcagctctgtcgcaattccctccggataacaagcgtttggtgaatgtcgcccagcatctgccgaaacctttggaggaggtgaagtactactacgaaaagttggtcaacgatgtttatctgccgaaacctttagagaatgtcacccagcatctgcagaaacctatggaaatggaggagatgaagtacatgtacgaaaagatggccaacgatgttaatcagatgcccgagtacgtaccactggcggaatcgagtcagtccaaacgcaggaagaaggatacgccaaatccttggacagaagaggaacacagattgtttctgcaaggattgaaaaagtatggggaaggagcttcgacgttgacatcaacgaattttgtgaagacaaagactccacggcaagtgtcaagccatgcacagtattacaaaaggcaaaaatcggacaataagaaggagaaacgccggagtatttttgacataactttggagtctaccgagggcaatccagattctggaaatcagaaccctccggatgatgatgatccgtcccaaggtcaaggcacttgtcttggagtttagatgttggaagatagaagaatggtgtgaaagc

SEQ ID NO: 2850 - protein, 206 aa, Arabidopsis thaliana
  G2313
MASSPRWTEDDNRRFKSALSQFPPDNKRLVNVAQHLPKPLEEVKYYYEKLVNDVYLPKPLENVTQHLQKPMEMEEMKYMYEKMANDVNQMPEYVPLAESSQSKRRKKDTPNPWTEEEHRLFLQGLKKYGEGASTLTSTNFVKTKTPRQVSSHAQYYKRQKSDNKKEKRRSIFDITLESTEGNPDSGNQNPPDDDDPSQGQGTCLGV

SEQ ID NO: 2851 - DNA, 573 bp, Arabidopsis thaliana
  G2344
atgacttcttcaatccatgagctttctgataacattggaagtcatgagaagcaagaacagagagattctcatttccaaccaccaatcccttctgcaagaaattatgaatcaattgttacaagtttagtctactcagacccggggactacaaattccatggcacctggacaatatccatatccagatccttactacagaagcatatttgcaccgcctccacaaccgtataccggggtacatctacagttgatgggagtgcagcaacaaggcgttcctttaccatctgatgcagtcgaggaacctgtttttgttaacgcaaagcaataccacggtatactaaggcgcagacaatcaagagcaagacttgagtctcagaataaagtcatcaagtcacgtaagccgtatttgcatgaatctcggcatttgcatgcgataagacgaccaagaggatgtggcgggcggtttctaaatgccaagaaggaggatgagcatcacgaagacagtagtcatgaagaaaaatccaaccttagcgctggtaaatccgccatggctgcttctagtggtacatcttga

SEQ ID NO: 2852 - protein, 190 aa, Arabidopsis thaliana
  G2344
MTSSIHELSDNIGSHEKQEQRDSHFQPPIPSARNYESIVTSLVYSDPGTTNSMAPGQYPYPDPYYRSIFAPPPQPYTGVHLQLMGVQQQGVPLPSDAVEEPVFVNAKQYHGILRRRQSRARLESQNKVIKSRKPYLHESRHLHAIRRPRGCGGRFLNAKKEDEHHEDSSHEEKSNLSAGKSAMAASSGTS

SEQ ID NO: 2853 - DNA, 1263 bp, Arabidopsis thaliana
  G2373
gcaaaatcctcagatcgtcttaccttctccgaatcgatcgatttttcatggaggacgacgacgagattcagtcaattccatctccgggagattcttccctttcaccacaagctcctccttctccgccgattttgccaacaaacgacgtgacggtggccgtcgtgaagaaaccacaaccggggctttcttctcaatctccgtccatgaacgctttagcgttagtggttcatactccttctgtaaccggtggtggtggtagcggaaacagaaacggacgaggaggaggaggaggaagcggtggtggtggaggaggaagagatgattgttggagcgaagaagctacaaaggttctaatcgaagcttggggagatcgattctctgaaccaggtaaaggaactttgaagcaacaacattggaaagaagtagctgagattgtgaacaagagtcgtcaatgcaaataccctaaaactgatattcagtgtaagaacagaattgatacggtgaagaagaagtataagcaagagaaagctaagattgcttctggtgatggacctagtaaatgggttttcttcaagaagcttgagagtttgattggtggtactacaacattcattgcttcttcaaaagcttcagagaaggctcctatgggaggagctcttgggaatagccgttcgagtatgtttaaacggcaaactaaaggtaatcagattgtgcagcaacaacaagagaagagaggctctgattcgatgcggtggcattttaggaaacgtagtgcttctgagactgagtctgagtctgatcctgaacctgaggcttctcctgaggaatctgctgagagtctcccacctttgcaaccgattcaaccgctttcgtttcatatgccaaagcggttgaaggtggataagagtggaggtggagggagtggagttggagatgtggcgagggcgatacttggatttacggaagcttatgagaaggcggaaactgctaagcttaagttaatggcggaactggaaaaggagaggatgaaatttgctaaagagatggagttgcagagaatgcagttcttgaaaactcaattggagataacacagaacaatcaagaagaggaagagaggagcaggcagcgaggagaaaggaggatcgttgatgatgatgatgatcgcaatggcaagaataacggcaatgtaagtagctgacaattgaacacacaaatgttcctatgatatttgctatgataagctggattttaggttttgatgg

SEQ ID NO: 2854 - protein, 383 aa, Arabidopsis thaliana
  G2373
MEDDDEIQSIPSPGDSSLSPQAPPSPPILPTNDVTVAVVKKPQPGLSSQSPSMNALALVVHTPSVTGGGGSGNRNGRGGGGGSGGGGGGRDDCWSEEATKVLIEAWGDRFSEPGKGTLKQQHWKEVAEIVNKSRQCKYPKTDIQCKNRIDTVKKKYKQEKAKIASGDGPSKWVFFKKLESLIGGTTTFIASSKASEKAPMGGALGNSRSSMFKRQTKGNQIVQQQQEKRGSDSMRWHFRKRSASETESESDPEPEASPEESAESLPPLQPIQPLSFHMPKRLKVDKSGGGGSGVGDVARAILGFTEAYEKAETAKLKLMAELEKERMKFAKEMELQRMQFLKTQLEITQNNQEEEERSRQRGERRIVDDDDDRNGKNNGNVSS

SEQ ID NO: 2855 - DNA, 1414 bp, Arabidopsis thaliana
  G2376
cacgagcttctgactcagatccggcgatatcgaattccatggaggacgatgaagacatccgatctcagggttccgattcacctgatccgtcttcctccccgccggcgggacgaatcacggttacggtggcttcggcaggtccgccttcttattctctgactcctccgggtaattcgtcgcagaaggatccggatgcgttggctctggcgctgcttccgattcaggccagcggtggagggaataacagcagtgggagaccaaccggcggcggcgggagggaggattgttggagcgaagcagctacggctgtgttgattgatgcgtggggtgagagatacttggagcttagcagagggaatctgaagcagaagcactggaaagaggtggctgagattgtgagcagcagagaggattacggtaaaattcccaaaactgatatacagtgtaagaataggatcgatacggtgaagaagaagtataaacaagagaaggtgagaatcgctaacggcggtggccgtagcagatgggtgttcttcgacaagcttgaccgtctgattggatcaacggcgaagatcccgacggcaacttctggagtcagcggtcctgtcggaggattgcataagattcctatgggtattccaatgggaagtcgttcgaatctgtaccatcagcaagctaaggctgcaacaccgcctttcaataatcttgaccggttaattggagctacggctagagtctcagctgcttctttcggtggcagtggtggaggaggcggaggaggatctgtcaatgtacctatgggaattccgatgagtagccgttcagctccgtttggacagcaagggaggactctgccacagcaaggtaggacactgccacagcaacagcagcaagggatgatggtgaaaaggtgtagtgagtcgaaacgctggcgtttcaggaagaggaacgcttctgattcagactcggaatctgaagcagcaatgtcagatgattccggtgacagtttaccacctcctcctctgtcgaagaggatgaagacggaggagaagaagaagcaagatggtgatggagtggggaacaaatggagggagctgactcgggcaatcatgagattcggtgaagcttatgagcaaacagagaatgcgaaactgcaacaggtggttgagatggagaaagagaggatgaagttcttgaaggagcttgagttgcagagaatgcagttctttgtgaagactcaattggagatatcacaacttaagcagcaacatgggaggagaatgggaaacaccagtaatgatcatcatcacagccgcaagaacaacatcaatgcgattgtcaacaacaacaacgatttgggtaataactagaatttagtgatgcagtgtcgtaattgatatattttagatttgag

SEQ ID NO: 2856 - protein, 443 aa, Arabidopsis thaliana
  G2376
MEDDEDIRSQGSDSPDPSSSPPAGRITVTVASAGPPSYSLTPPGNSSQKDPDALALALLPIQASGGGNNSSGRPTGGGGREDCWSEAATAVLIDAWGERYLELSRGNLKQKHWKEVAEIVSSREDYGKIPKTDIQCKNRIDTVKKKYKQEKVRIANGGGRSRWVFFDKLDRLIGSTAKIPTATSGVSGPVGGLHKIPMGIPMGSRSNLYHQQAKAATPPFNNLDRLIGATARVSAASFGGSGGGGGGGSVNVPMGIPMSSRSAPFGQQGRTLPQQGRTLPQQQQQGMMVKRCSESKRWRFRKRNASDSDSESEAAMSDDSGDSLPPPPLSKRMKTEEKKKQDGDGVGNKWRELTRAIMRFGEAYEQTENAKLQQVVEMEKERMKFLKELELQRMQFFVKTQLEISQLKQQHGRRMGNTSNDHHHSRKNNINAIVNNNNDLGNN

SEQ ID NO: 2857 - DNA, 1001 bp, Arabidopsis thaliana
  G2380
tggcgacgccttcgccgacctcctctcctccctctgattcaaaccctaattctgccgctactccgccgcatcagaaacaaccaccctctcctcctcaacccacgaatccatcctctccaccaccgcacaccaccgtcgtagctttagccgcatcaacctccgccgtcgccagaaaaacccaacctgttctctggactcaagacgagaccctcctcttaatcgaatcatacaaagagaaatggttcgcaattggtcgtggtcctctaaaatcaactcactgggaagagatcgccgttgctgcctcatctcgttccggcgttgaacggacatctacacagtgtaggcataagatcgagaagatgcgtaaaagattccgatctgagagacagagtatgggacctatctcaatttggcctttctataatcaaatggaggaattggattcttcaaatcctgctccgatctcagctcgtcctctcactcgtcttcctcctaattcgaataatcgctacgtagacgacgaagaagaagatgaagaagaggataacaataactacgaagaagaggaagaagaagatgagagacagagcaaatcgaggagtattaattacatattgagaagacctggaactgttaacagatttgctggagttggtggaggattgttgtcatggggacaaaaagagagatcatcgaagaggaagaggaacgatggagacggtggtgagaggcggaggaaaggaatgcgagccgttgcagcggagattagggcgtttgctgagagagtaatggtaatggagaagaagaagattgagtttgctaaagagactgtgagacttcgtaaggaaatggagattcgtagaatcaatttgattcagagttctcaaactcagcttcttcaatttatcaacaatgcttttgattctttctaacgtagagatttagtcattgttgcttttagatttgtaacataggtaacggatttgaagaaatgcactatg

SEQ ID NO: 2858 - protein, 190 aa, Arabidopsis thaliana
  G2380
MRKRFRSERQSMGPISIWPFYNQMEELDSSNPAPISARPLTRLPPNSNNRYVDDEEEDEEEDNNNYEEEEEEDERQSKSRSINYILRRPGTVNRFAGVGGGLLSWGQKERSSKRKRNDGDGGERRRKGMRAVAAEIRAFAERVMVMEKKKIEFAKETVRLRKEMEIRRINLIQSSQTQLLQFINNAFDSF

SEQ ID NO: 2859 - DNA, 1050 bp, Arabidopsis thaliana
  G2383
gacctctttgatcccttcattccccatcaaacaaccatgtttccttctttcattactcacattcaaagccctaattctcaccatcactactcttcgccttcttttcctttctcttccgattttcttgagagttttgatgaatccttcttgataaaccaattcttgttacagcagcaagatgtagcagcaaatgttgttgaatctccttggaaattttgcaagaagcttgagcttaagaagaagaatgagaagtgtgttgatggaagcacctcacaagaggttcaatggagaaggacggtcaaaaaaagggacaggcatagtaagatctgcacggctcaaggtcctagagaccggaggatgaggctgtctcttcagattgctcgcaagtttttcgatcttcaagacatgttgggtttcgacaaggcgagcaagacgattgaatggcttttctccaaatcaaagacttccatcaaacaacttaaagaaagagtggctgcatcggaaggaggaggaaaggatgaacatctccaggttgatgaaaaggaaaaggatgagacactgaagttgagagtctcaaagagaagaacaaagactatggagagctcttttaagactaaagagtcgagagagagagctagaaagcgagcaagagagagaacaatggcaaagatgaagatgagattatttgagacctcggaaacaatttcagatcctcatcaagaaactagagagatcaagataaccaatggtgtacaattactagaaaaggaaaataaagaacaagaatggagtaatactaatgatgttcacatggtagagtatcaaatggattctgtgagcatcatagagaagtttcttggactaaccagtgactctagctcctcttccatttttggtgactccgaggaatgttacacaagtcttagttcagtaagaggtacaatttcagcagcaggtaacagcaatgtgttaactaaaaaccctaattgagtaatgcagttttgattaatattagctttttggtaattccaggaatgtcgacaccaaggg

SEQ ID NO: 2860 - protein, 317 aa, Arabidopsis thaliana
  G2383
MFPSFITHIQSPNSHHHYSSPSFPFSSDFLESFDESFLINQFLLQQQDVAANVVESPWKFCKKLELKKKNEKCVDGSTSQEVQWRRTVKKRDRHSKICTAQGPRDRRMRLSLQIARKFFDLQDMLGFDKASKTIEWLFSKSKTSIKQLKERVAASEGGGKDEHLQVDEKEKDETLKLRVSKRRTKTMESSFKTKESRERARKRARERTMAKMKMRLFETSETISDPHQETREIKITNGVQLLEKENKEQEWSNTNDVHMVEYQMDSVSIIEKFLGLTSDSSSSSIFGDSEECYTSLSSVRGTISAAGNSNVLTKNPN

SEQ ID NO: 2861 - DNA, 1409 bp, Arabidopsis thaliana
  G2417
cataccggtggaagattctgctttactacgctctccgcttcttcttctcctcgattcgattctcctcatgggtttatcatgaatttttaggttttgagtaattcagaaactcgagtgatgatcccgaatgatgatgatgatgcaaattctatgaagaattatccgttaaatgatgatgatgcaaattctatgaagaattatccgttaaatgatgatgatgcaaattctatggagaattatccgttaaggtcaattccgacggagctttcacacacttgttcattgataccaccttctttaccaaacccttcagaagcagcagcagacatgtccttcaattcagaactcaatcaaatcatggcaaggccttgtgatatgctccctgccaatggtggagctgttggtcataacccttttttggaaccaggattcaactgccccgagacaacagattggattccctctccactcccccatatttattttccttcgggttctcccaatctaataatggaggatggtgtcattgatgagattcacaaacaaagtgacttgccactttggtatgacgacttgattaccactgatgaagatccactcatgtctagtatcttgggcgatcttctccttgacactaatttcaactcagcttcaaaggtccagcaaccaagtatgcaatcgcagattcaacaaccccaagctgttctgcagcagccttcttcttgtgtggaattgcgcccacttgataggacagtatcctcaaacagcaacaacaatagcaacagtaataatgcagcagcagcagctaagggacgtatgcgttggacgcctgaacttcatgaggtttttgttgacgctgttaaccagctcggtggcagtaatgaagcaactcctaaaggtgtcctgaagcatatgaaagtcgaaggtttgactatttttcatgtcaaaagtcatttgcagaaatatagaacagctaaatatataccagtaccatcagaaggttcgccggaggcaaggttgacaccgcttgagcaaattacatctgatgatacgaaacgtgggatagatatcactgagactctgcgaattcagatggaacatcagaagaaactgcatgagcagcttgagagtctaagaacaatgcaacttcggatagaagagcaaggaaaggcgctgttgatgatgattgagaagcaaaatatgggtttcggcggaccagaacaaggagagaaaacaagtgcgaaaacgcctgaaaatggttcagaggagtcggaatccccgcggccaaagcgtccgagaaatgaagaatgaaggaaacctttcttcggatggtagatcataaaactgtggttttggtggagttgtagagtatgacttattaggagtagagctttcagtcttcttcaggc

SEQ ID NO: 2862 - protein, 397 aa, Arabidopsis thaliana
  G2417
MIPNDDDDANSMKNYPLNDDDANSMKNYPLNDDDANSMENYPLRSIPTELSHTCSLIPPSLPNPSEAAADMSFNSELNQIMARPCDMLPANGGAVGHNPFLEPGFNCPETTDWIPSPLPHIYFPSGSPNLIMEDGVIDEIHKQSDLPLWYDDLITTDEDPLMSSILGDLLLDTNFNSASKVQQPSMQSQIQQPQAVLQQPSSCVELRPLDRTVSSNSNNNSNSNNAAAAAKGRMRWTPELHEVFVDAVNQLGGSNEATPKGVLKHMKVEGLTIFHVKSHLQKYRTAKYIPVPSEGSPEARLTPLEQITSDDTKRGIDITETLRIQMEHQKKLHEQLESLRTMQLRIEEQGKALLMMIEKQNMGFGGPEQGEKTSAKTPENGSEESESPRPKRPRNEE

SEQ ID NO: 2863 - DNA, 1038 bp, Arabidopsis thaliana
  G2426
atgggcagatcgccatgttgtgataaggccgggttgaagaaagggccttggactccagaagaggatcagaaacttttggcttatattgaagaacatggccatggaagctggcgttctttgcctgagaaagccggtctccaaaggtgtggaaagagttgcagactcagatggactaactacctaagacctgacatcaagagaggcaaattcactgtacaagaagaacaaaccatcattcaactccacgctctcctcggaaacaggtggtcagcgattgcaactcatttaccaaagaggacagacaacgagatcaagaactactggaacacacacttgaagaaacgtctgatcaaaatggggatagatccagtgactcacaagcacaaaaacgagactctttcgtcttccacaggacaatcaaagaacgcagccacgcttagtcatatggctcaatgggagagtgcaagactcgacgctgaagcaaggctagctagagaatcaaagcttctccatttacagcattaccaaaacaataacaaccttaacaaatcagcagctcctcaacaacattgcttcactcaaaaaacatcaacaaactggactaaaccaaaccaaggaaacggagaccaacagcttgaatctccgacatcgacggtgacattctctgagaatcttctgatgcctttaggaatccctacggatagcagcagaaatagaaacaataacaacaatgagtcctcggcgatgattgaattggccgtatcttcgtcaacctcctccgatgtgagtctggtcaaagaacatgaacacgactggattaggcagatcaactgtggtagtggaggaataggagaaggattcacgagtctattgatcggtgattcggtcggccggggtttacccaccgggaaaaacgaagcgacggcgggcgtggggaatgagagtgagtataactactatgaggataacaagaattactggaatagcattctcaacttggttgattcttcaccgtccgattccgcgacgatgttctga

SEQ ID NO: 2864 - protein, 345 aa, Arabidopsis thaliana
  G2426
MGRSPCCDKAGLKKGPWTPEEDQKLLAYIEEHGHGSWRSLPEKAGLQRCGKSCRLRWTNYLRPDIKRGKFTVQEEQTIIQLHALLGNRWSAIATHLPKRTDNEIKNYWNTHLKKRLIKMGIDPVTHKHKNETLSSSTGQSKNAATLSHMAQWESARLDAEARLARESKLLHLQHYQNNNNLNKSAAPQQHCFTQKTSTNWTKPNQGNGDQQLESPTSTVTFSENLLMPLGIPTDSSRNRNNNNNESSAMIELAVSSSTSSDVSLVKEHEHDWIRQINCGSGGIGEGFTSLLIGDSVGRGLPTGKNEATAGVGNESEYNYYEDNKNYWNSILNLVDSSPSDSATMF

SEQ ID NO: 2865 - DNA, 1106 bp, Arabidopsis thaliana
  G2431
ccctttcgtttttatttaaatttcttgggtcgtttcttaaatttgtatgtgtttattaatggagatcaacaataatgccaacaatactaatactactattgataatcacaaggcaaagatgagccttgtgttgtcaacggatgctaagccaaggttgaaatggacttgtgatcttcatcacaaattcatcgaagccgttaatcaacttggaggacctaacaaagcaacacctaagggtttgatgaaggttatggagattcctgggcttaccttataccatctcaagagccatttacagaaatatcggttagggaagagcatgaagttcgatgataacaagctagaagtttcctctgcatcagagaatcaagaagttgagagtaaaaacgattcaagagatctccgaggctgcagtgtcaccgaagaaaacagcaatccagctaaagaagggctacaaatcacagaggctttacaaatgcagatggaagttcagaagaaacttcatgaacaaatcgaagttcagaggcatttgcaggtgaagattgaggcacaaggaaagtatctacagtccgttttaatgaaagctcaacaaactctcgctggctactcatcttcaaatctcggcatggattttgcgaggaccgagctctctagattagcttcaatggtgaacagaggctgtccaagcacttcgttctcagagctaacgcaagtagaagaagaagaagaaggtttcttgtggtacaagaaaccagaaaacagaggaattagtcagctgagatgttcagtagagagctcgttgacatcttcagagacctcagagacaaaactggatactgacaataaccttaataaatcgattgaacttccgttgatggagatcaactcggaagtgatgaaggggaagaagagaagcataaacgacgtcgtttgcgtggagcagcctctaatgaagagagcttttggagttgatgatgatgagcatttgaagttgagtttgaatacttacaagaaagacatggaggcgtgtacgaacataggactagggtttaattaaaaaaaaaacattttactaaagttatataaaaatgttttaaaagaatcca

SEQ ID NO: 2866 - protein, 336 aa, Arabidopsis thaliana
  G2431
MCLLMEINNNANNTNTTIDNHKAKMSLVLSTDAKPRLKWTCDLHHKFIEAVNQLGGPNKATPKGLMKVMEIPGLTLYHLKSHLQKYRLGKSMKFDDNKLEVSSASENQEVESKNDSRDLRGCSVTEENSNPAKEGLQITEALQMQMEVQKKLHEQIEVQRHLQVKIEAQGKYLQSVLMKAQQTLAGYSSSNLGMDFARTELSRLASMVNRGCPSTSFSELTQVEEEEEGFLWYKKPENRGISQLRCSVESSLTSSETSETKLDTDNNLNKSIELPLMEINSEVMKGKKRSINDVVCVEQPLMKRAFGVDDDEHLKLSLNTYKKDMEACTNIGLGFN

SEQ ID NO: 2867 - DNA, 1002 bp, Arabidopsis thaliana
  G2442
tcgaccaatttagaccattccaaattcgtcgtccttttctctgtgtagtctaattatatattacaagtagatgaattggttacctgaagctgaagctgaggagcacttgaaaggtattctctctggtgatttctttgatggtctcaccaatcaccttgattgcccacttgaagacatcgattccaccaatggtgagggagattgggtcgccaggtttcaagaccttgagcctcctcccttggatatgttccctgctttgccttctgacctcacctcttgtcccaagggcgccgctcgtgtgcggattcccaacaacatgattcctgctttgaagcagtcctgttcttctgaagccttgtccggcattaatagcactccccaccaatcttcagctcctcctgatatcaaagtttcatatctatttcagtctctaactccagtgtcagttctcgagaacagttatggttctctctccacccaaaactccggatctcagagattggctttccctgtgaaaggcatgagaagcaagcgcagacgccccacaacagtgagacttagctaccttttcccctttgaacccagaaagtcaactccgggtgaatcagtaaccgagggttactattcttctgagcaacatgccaagaagaagcgcaagattcatctgatcacccacaccgagtcttccactttggagtcaagtaagtcggatgggatagtccggatatgcactcattgtgagacaatcacgaccccacagtggaggcaaggacccagtggacccaagaccctctgcaacgcttgcggagtccggttcaaatctggtcgcctagttccagaataccggccagcctcaagcccgaccttcatcccatctgtgcattcaaactcacacaggaagatcattgagatgagaaagaaggacgacgagtttgataccagcatgattcgcagtgatatccagaaggtaaagcaggggaggaagaaaatggtataaaagta

SEQ ID NO: 2868 - protein, 308 aa, Arabidopsis thaliana
  G2442
MNWLPEAEAEEHLKGILSGDFFDGLTNHLDCPLEDIDSTNGEGDWVARFQDLEPPPLDMFPALPSDLTSCPKGAARVRIPNNMIPALKQSCSSEALSGINSTPHQSSAPPDIKVSYLFQSLTPVSVLENSYGSLSTQNSGSQRLAFPVKGMRSKRRRPTTVRLSYLFPFEPRKSTPGESVTEGYYSSEQHAKKKRKIHLITHTESSTLESSKSDGIVRICTHCETITTPQWRQGPSGPKTLCNACGVRFKSGRLVPEYRPASSPTFIPSVHSNSHRKIIEMRKKDDEFDTSMIRSDIQKVKQGRKKMV

SEQ ID NO: 2869 - DNA, 804 bp, Arabidopsis thaliana
  G2452
atgtcatcgtcgacgatgtacagaggagttaatatgttttcaccggcaaacacaaactggatttttcaagaagtcagagaagccacgtggacggcggaggagaacaaacggttcgagaaagctctcgcttatctggacgacaaagacaatcttgagagctggtccaagatcgcagatttgattcccggcaaaacagtagctgacgtcattaaacgatacaaggagctagaggatgatgtcagcgacatcgaagccggacttatccccattccgggatacggcggcgacgcctcctccgctgcaaacagtgactatttctttggtctagaaaactccagctacggttatgattacgtcgttggaggaaagaggagttcgccggcgatgactgattgttttaggtctccgatgccggaaaaggagaggaagaaaggagttccgtggaccgaggacgaacacctacgatttctgatgggtttgaagaaatatggaaaaggagattggagaaacatagcaaaaagctttgtgacgactcgaacgccgacgcaagtcgcttcacacgctcagaaatattttcttcgacaactcacagatggtaaagacaaaagacgatcaagtattcacgatatcaccactgttaacatccctgacgcagacgcatccgcaaccgccacgaccgctgacgtagcactctctcctactccagccaattcttttgacgttttccttcagccaaatcctcattacagtttcgcgtctgcgtctgcgtctagctattataatgcgtttccgcagtggagttaa

SEQ ID NO: 2870 - protein, 267 aa, Arabidopsis thaliana
  G2452
MSSSTMYRGVNMFSPANTNWIFQEVREATWTAEENKRFEKALAYLDDKDNLESWSKIADLIPGKTVADVIKRYKELEDDVSDIEAGLIPIPGYGGDASSAANSDYFFGLENSSYGYDYVVGGKRSSPAMTDCFRSPMPEKERKKGVPWTEDEHLRFLMGLKKYGKGDWRNIAKSFVTTRTPTQVASHAQKYFLRQLTDGKDKRRSSIHDITTVNIPDADASATATTADVALSPTPANSFDVFLQPNPHYSFASASASSYYNAFPQWS

SEQ ID NO: 2871 - DNA, 1223 bp, Arabidopsis thaliana
  G2465
caatattctttctccattgagattaagcttctttctcgctgtcgtctctctatagatcttggttcttagtcccttttgaataataatgatggtggagatggattacgctaagaaaatgcagaaatgtcatgaatacgttgaagcacttgaagaagaacagaagaaaatccaagtctttcaacgcgagcttcctttatgtttagagcttgtcactcaagcgatcgaagcttgtcggaaggagttatctggtacgacgacaactacatcagaacagtgttcagaacagaccacaagtgtttgtggtggtcctgtctttgaagagtttattcctatcaagaaaattagttccttgtgtgaagaagtacaagaagaagaagaagaagatggtgaacatgaatcttctccagaacttgtgaataataagaaatcagattggcttagatctgttcagctatggaatcattcaccggatctaaatccaaaagaggagcgtgtagctaagaaagcgaaagtggtggaggtgaaaccaaaaagcggtgcgtttcagccgtttcaaaagcgcgttttggagactgatttgcaaccggcggtgaaagtagctagttcgatgccagcgacgacgacgagttctacgacggaaacttgtggtggtaaaagtgatttgattaaagctggagatgaggaaagacggatagagcagcagcaatcgcagtcgcatacgcatagaaaacaaaggcggtgctggtcgccggaattacaccgtcgattcctaaacgcgcttcagcagcttggaggatctcatgttgctacaccaaagcaaatcagggatcacatgaaggttgatggattaacaaacgacgaagttaaaagccatttacagaaatatagacttcacacaagaaggccagcagcaacatccgtggcggcacaaagtaccgggaatcagcaacaaccacaatttgtggtggttggaggcatatgggtaccatcgtcacaagattttccaccaccgtccgatgtagccaacaagggtggtgtatatgctccggttgcggtggcgcaatctccaaaacgttcgttggagagaagttgcaactcgccggcggcatcttcctctacaaatacaaatacttctactcctgtgtcataatctgatagtcatactataatcatctcctgatgttgattttggtgtaggtttgaaaatgtttatgtgaatgtaa

SEQ ID NO: 2872 - protein, 354 aa, Arabidopsis thaliana
  G2465
MMVEMDYAKKMQKCHEYVEALEEEQKKIQVFQRELPLCLELVTQAIEACRKELSGTTTTTSEQCSEQTTSVCGGPVFEEFIPIKKISSLCEEVQEEEEEDGEHESSPELVNNKKSDWLRSVQLWNHSPDLNPKEERVAKKAKVVEVKPKSGAFQPFQKRVLETDLQPAVKVASSMPATTTSSTTETCGGKSDLIKAGDEERRIEQQQSQSHTHRKQRRCWSPELHRRFLNALQQLGGSHVATPKQIRDHMKVDGLTNDEVKSHLQKYRLHTRRPAATSVAAQSTGNQQQPQFVVVGGIWVPSSQDFPPPSDVANKGGVYAPVAVAQSPKRSLERSCNSPAASSSTNTNTSTPVS

SEQ ID NO: 2873 - DNA, 867 bp, Arabidopsis thaliana
  G2510
ataacaaactctttaatgtcaccacagagaatgaagctatcatcaccaccagttaccaacaacgaaccaaccgccaccgcttctgccgttaaatcttgcggcggaggaggtaaagaaaccagctcatcgaccacgaggcatccagtgtaccacggagttcgcaaacgccgatggggaaaatgggtttctgagatcagagagccccggaaaaagtctcggatttggctcggatcttttccggtgccggagatggctgctaaggcctacgacgtggcagcgttttgtctaaaaggtagaaaagctcagctgaatttccctgaagaaatcgaggatctacctcgaccgtccacgtgtactcccagagatatccaagtcgcagcggccaaagcagccaacgccgtgaagatcatcaaaatgggagatgatgacgtggcaggaatagacgacggagatgatttctgggaaggcattgagctgcctgagcttatgatgagtggaggtgggtggtcgccggagccttttgttgccggagatgatgccacgtggcttgtcgacggagacttgtatcagtatcagttcatggcgtgtctgtgagtgttgctgtcgattgtgtcgtattcgttatacgtgtacgttgtatcgttattgtgttggctcacttaatttaatgcatatgcatgtatattttcatttatttgtttctagtttattgttttacgcgattaataattagatacctgtttctcaagttagttatcaggtttgtacgcatctacaaaaatacgtataagtgtatgttcttatatacagtttttgtttgcataagtattgctacttattctaaaaaaaaaaaaaaaaaaaaaaaaa

SEQ ID NO: 2874 - protein, 192 aa, Arabidopsis thaliana
  G2510
MSPQRMKLSSPPVTNNEPTATASAVKSCGGGGKETSSSTTRHPVYHGVRKRRWGKWVSEIREPRKKSRIWLGSFPVPEMAAKAYDVAAFCLKGRKAQLNFPEEIEDLPRPSTCTPRDIQVAAAKAANAVKIIKMGDDDVAGIDDGDDFWEGIELPELMMSGGGWSPEPFVAGDDATWLVDGDLYQYQFMACL

SEQ ID NO: 2875 - DNA, 832 bp, Arabidopsis thaliana
  G2512
aacttagtgccacttagacacaataagaaaaccgttaacaagaagaaaaaaaaaagatcgaaaatggaatatcaaactaacttcttaagtggagagttttccccggagaactcttcttcaagctcatggagctcacaagaatcattcttgtgggaagagagtttcttacatcaatcatttgaccaatccttccttttatctagccctactgataactactgtgatgacttctttgcatttgaatcatcaatcataaaagaagaaggaaaagaagccaccgtggcggccgaggaggaggagaagtcatacagaggagtgaggaaacggccgtgggggaaattcgcggccgagataagagactcaacgaggaaagggataagagtgtggcttgggacattcgacaccgcggaggcggcggctctcgcttatgatcaggcggctttcgctttgaaaggcagcctcgcagtactcaatttccccgcggatgtcgttgaagaatctctccggaagatggagaatgtgaatctcaatgatggagagtctccggtgatagccttgaagagaaaacactccatgagaaaccgtcctagaggaaagaagaaatcttcttcttcttcgacgttgacatcttctccttcttcctcctcctcctattcatcttcttcgtcttcttcttctttgtcgtcaagaagtagaaaacagagtgttgttatgacgcaagaaagtaatacaacacttgtggttcttgaggatttaggtgctgaatacttagaagagcttatgagatcatgttcttgataatctctgcttctacaatttttatgtaatttga

SEQ ID NO: 2876 - protein, 244 aa, Arabidopsis thaliana
  G2512
MEYQTNFLSGEFSPENSSSSSWSSQESFLWEESFLHQSFDQSFLLSSPTDNYCDDFFAFESSIIKEEGKEATVAAEEEEKSYRGVRKRPWGKFAAEIRDSTRKGIRVWLGTFDTAEAAALAYDQAAFALKGSLAVLNFPADVVEESLRKMENVNLNDGESPVIALKRKHSMRNRPRGKKKSSSSSTLTSSPSSSSSYSSSSSSSSLSSRSRKQSVVMTQESNTTLVVLEDLGAEYLEELMRSCS

SEQ ID NO: 2877 - DNA, 908 bp, Arabidopsis thaliana
  G2519
caaagtgaaaacataagatcatcttcttcgttgatagatcaatataggaactccagaagagaatcttgatcaattaagtatcatgtctcacatcgctgttgaaaggaatcgaagaaggcaaatgaacgagcatcttaaatcccttcgttctttgactccttgtttctacatcaaaaggggagatcaagcttcgatcatcggaggagtgatagagttcatcaaagagttgcagcaattggttcaagttcttgagtccaagaaacgtcgaaagaccctaaaccgaccatctttcccttatgatcaccagacaatcgagccatccagtttaggagccgccactacccgagtaccgtttagtcgaatcgaaaatgtgatgaccacaagtactttcaaggaagtaggagcatgctgtaactcccctcatgctaacgtagaagcaaagatttcaggttctaatgttgtattgagagttgtctctaggcgaatcgtggggcagctcgtaaagatcatctctgtcttagagaagctatcttttcaagttcttcacctcaatattagtagcatggaggagactgtcttatactttttcgttgttaagataggattggagtgtcacttaagcttggaggagctaactcttgaagttcagaaaagctttgtgtctgatgaagtgatcgtctctaccaattaaaaacaaaattctacatgtactagagcgtgtatcgttttttgggattaataatcatataatcgttacatgagccttgatactttgctagaaataagctcctctaaacaaaaccttctttttaaaaaaacacacttatgttttacttagtttgttgttgtatccgaagttgatcaacgttgtaatttcccacaataaatcatgacattttatatgctct

SEQ ID NO: 2878 - protein, 202 aa, Arabidopsis thaliana
  G2519
MSHIAVERNRRRQMNEHLKSLRSLTPCFYIKRGDQASIIGGVIEFIKELQQLVQVLESKKRRKTLNRPSFPYDHQTIEPSSLGAATTRVPFSRIENVMTTSTFKEVGACCNSPHANVEAKISGSNVVLRVVSRRIVGQLVKIISVLEKLSFQVLHLNISSMEETVLYFFVVKIGLECHLSLEELTLEVQKSFVSDEVIVSTN

SEQ ID NO: 2879 - DNA, 992 bp, Arabidopsis thaliana
  G2521
attctccacaatttcataactttcttccgctcaacttcagataaattcggattctgtagctctttcaatacgactgcggagatcagagccaattatttggttatggcgtctctgatctcagatattgaaccgccgacgagtactacttcagatctcgttcggagaaagaagagatcctctgcttcatccgccgcatcgtctcgttcaagcgcatcttccgtctccggtgagattcacgcgcgatggcgatcggagaagcaacaacggatctactcagccaaactgttccaagcgctccaacaagtccgcctcaactcttccgcctcaacatcatcatctccaacggctcagaaacgaggaaaggccgtccgtgaagccgccgatcgagctcttgccgtttccgctcggggaagaacactctggagcagagcgatcttagctaatcggatcaaactgaaatttcgtaaacagagacgtcctcgagctacgatggcgattccggccatgactacggtggttagtagcagcagcaacagatcgagaaaacggagagtgtcggtgttgagattgaataagaagagtataccggatgttaaccggaaagtacgtgttctaggccggttagttcccggttgcggtaaacaatccgtaccggtgattctagaagaagcaactgattatattcaggctctggagatgcaagtgagagccatgaactctttagttcagcttctctcctcctacggctcagctcctccaccgatttgatgaggttaaaatcgtctttttaattctaccatctctcgatctttcacagcttatgtgtatatagaagattcggtttgattataatctgtaactactcttcccaaccgctgattcttctctgctacaagtaaaagtaaattttgaaccgagtcttcccatttttacgatcctcaagtctaaattaagtatatgattgattaataaagtctttaccattagggttc

SEQ ID NO: 2880 - protein, 221 aa, Arabidopsis thaliana
  G2521
MASLISDIEPPTSTTSDLVRRKKRSSASSAASSRSSASSVSGEIHARWRSEKQQRIYSAKLFQALQQVRLNSSASTSSSPTAQKRGKAVREAADRALAVSARGRTLWSRAILANRIKLKFRKQRRPRATMAIPAMTTVVSSSSNRSRKRRVSVLRLNKKSIPDVNRKVRVLGRLVPGCGKQSVPVILEEATDYIQALEMQVRAMNSLVQLLSSYGSAPPPI

SEQ ID NO: 2881 - DNA, 1080 bp, Arabidopsis thaliana
  G2533
atgataagcaaggatccaatatcgagtttacctccagggtttcgatttcatccaacagatgaagaactcattctccattacctaaggaagaaagtttcctcttccccagtcccgctttcgattatcgccgatgtcgatatctacaaatccgatccatgggatttaccagctaaggctccatttggggagaaagagtggtattttttcagtccgagggataggaaatatccaaacggagcaagaccaaacagagcagctgcgtctggatattggaaagcaaccggaacagataaattgattgcggtaccaaatggtgaagggtttcatgaaaacattggtataaaaaaagctcttgtgttttatagaggaaagcctccaaaaggtgttaaaaccaattggatcatgcatgaatatcgtcttgccgattcattatctcccaaaagaattaactcttctaggagcggtggtagcgaagttaataataattttggagataggaattctaaagaatattcgatgagactggatgattgggttctttgccggatttacaagaaatcacacgcttcattgtcatcacctgatgttgctttggtcacaagcaatcaagagcatgaggaaaatgacaacgaaccattcgtagaccgcggaacctttttgccaaatttgcaaaatgatcaaccccttaaacgccagaagtcttcttgttcgttctcaaacttactagacgctacagatttgacgtttctcgcaaattttctaaacgaaaccccggaaaatcgttctgaatcagatttttctttcatgattggcaatttctctaatcctgacatttacggaaaccattacttggatcagaagttaccgcagttgagctctcccacttcagagacaagcggcatcggaagcaaaagagagagagtggattttgcggaagaaacgataaacgcttcgaagaagatgatgaacacatatagttacaataatagtatagatcaaatggatcatagtatgatgcaacaacctagtttcctgaaccaggaactcatgatgagttctcaccttcaatatcaaggctag

SEQ ID NO: 2882 - protein, 359 aa, Arabidopsis thaliana
  G2533
MISKDPISSLPPGFRFHPTDEELILHYLRKKVSSSPVPLSIIADVDIYKSDPWDLPAKAPFGEKEWYFFSPRDRKYPNGARPNRAAASGYWKATGTDKLIAVPNGEGFHENIGIKKALVFYRGKPPKGVKTNWIMHEYRLADSLSPKRINSSRSGGSEVNNNFGDRNSKEYSMRLDDWVLCRIYKKSHASLSSPDVALVTSNQEHEENDNEPFVDRGTFLPNLQNDQPLKRQKSSCSFSNLLDATDLTFLANFLNETPENRSESDFSFMIGNFSNPDIYGNHYLDQKLPQLSSPTSETSGIGSKRERVDFAEETINASKKMMNTYSYNNSIDQMDHSMMQQPSFLNQELMMSSHLQYQG

SEQ ID NO: 2883 - DNA, 975 bp, Arabidopsis thaliana
  G2534
atggataatataatgcaatcgtcaatgccaccgggattccgatttcatccgacagaggaagagcttgtgggttattacctagataggaagatcaattcaatgaagagtgctttagatgtcattgtagagattgatctctacaaaatggagccatgggatatacaagcgaggtgtaaactagggtatgaagagcaaaacgagtggtacttctttagtcataaggacaggaagtaccctaccgggactaggaccaaccgagccactgcggctgggttctggaaagccacgggtagagacaaggcggtactatcaaaaaacagtgtcatcggaatgcggaagacacttgtctactacaagggtcgagctcctaatggaagaaagtccgattggatcatgcacgaataccgtctccaaaactccgagcttgccccggttcaggaggaaggctgggtggtgtgtcgagcatttaggaagccaattccaaaccagaggccattagggtacgagccatggcagaaccagctctaccacgtcgaaagtagtaacaactactcatcttcagtgacaatgaacacgagtcatcatatcggtgcatcttcatcaagtcataaccttaatcaaatgctcatgagcaataaccactacaatcctaataatacatcctcatcgatgcatcaatatggcaacattgagctcccgcagttggacagcccgagcttgtcgcctagtttagggacgaataaagatcagaacgagagtttcgagcaagaagaagagaagagctttaactgtgtggattggagaacactagataccttgcttgagacacaagtcatacatccgcataaccctaatattcttatgttcgaaacgcagtcgtataatccggcgccaagcttcccttccatgcatcaaagctataatgaggtcgaagctaatattcatcattctcttggatgcttccctgactcgtaa

SEQ ID NO: 2884 - protein, 324 aa, Arabidopsis thaliana
  G2534
MDNIMQSSMPPGFRFHPTEEELVGYYLDRKINSMKSALDVIVEIDLYKMEPWDIQARCKLGYEEQNEWYFFSHKDRKYPTGTRTNRATAAGFWKATGRDKAVLSKNSVIGMRKTLVYYKGRAPNGRKSDWIMHEYRLQNSELAPVQEEGWVVCRAFRKPIPNQRPLGYEPWQNQLYHVESSNNYSSSVTMNTSHHIGASSSSHNLNQMLMSNNHYNPNNTSSSMHQYGNIELPQLDSPSLSPSLGTNKDQNESFEQEEEKSFNCVDWRTLDTLLETQVIHPHNPNILMFETQSYNPAPSFPSMHQSYNEVEANIHHSLGCFPDS

SEQ ID NO: 2885 - DNA, 2169 bp, Arabidopsis thaliana
  G2543
atgagtttcgtcgtcggcgtcggcggaagtggtagtggaagcggcggagacggtggtggtagtcatcatcacgacggctctgaaactgataggaagaagaaacgttaccatcgtcacaccgctcaacagattcaacgccttgaatcgagtttcaaggagtgtcctcatccagatgagaaacagaggaaccagcttagcagagaattgggtttggctccaagacaaatcaagttctggtttcagaacagaagaactcagcttaaggctcaacatgagagagcagataatagtgcactaaaggcagagaatgataaaattcgttgcgaaaacattgctattagagaagctctcaagcatgctatatgtcctaactgtggaggtcctcctgttagtgaagatccttactttgatgaacaaaagcttcggattgaaaatgcacaccttagagaagagcttgaaagaatgtctaccattgcatcaaagtacatgggaagaccgatatcgcaactctctacgctacatccaatgcacatctcaccgttggatttgtcaatgactagtttaactggttgtggaccttttggtcatggtccttcactcgattttgatcttcttccaggaagttctatggctgttggtcctaataataatctgcaatctcagcctaacttggctatatcagacatggataagcctattatgaccggcattgctttgactgcaatggaagaattgctcaggcttcttcagacaaatgaacctctatggacaagaacagatggctgcagagacattctcaatcttggtagctatgagaatgttttcccaagatcaagtaaccgagggaagaaccagaactttcgagtcgaagcatcaaggtcttctggtattgtcttcatgaatgctatggcacttgtcgacatgttcatggattgtgtcaagtggacagaactctttccctctatcattgcagcttctaaaacacttgcagtgatttcttcaggaatgggaggtacccatgagggtgcattgcatttgttgtatgaagaaatggaagtgctttcgcctttagtagcaacacgcgaattctgcgagctacgctattgtcaacagactgaacaaggaagctggatagttgtaaacgtctcatatgatcttcctcagtttgtttctcactctcagtcctatagatttccatctggatgcttgattcaggatatgcccaatggatattccaaggttacttgggttgaacatattgaaactgaagaaaaagaactggttcatgagctatacagagagattattcacagagggattgcttttggggctgatcgttgggttaccactctccagagaatgtgtgaaagatttgcttctctatcggtaccagcgtcttcatctcgtgatctcggtggagtgattctatcaccggaagggaagagaagcatgatgagacttgctcagaggatgatcagcaactactgtttaagtgtcagcagatccaacaacacacgctcaaccgttgtttcggaactgaacgaagttggaatccgtgtgactgcacataagagccctgaaccaaacggcacagtcctatgtgcagccaccactttctggcttcccaattctcctcaaaatgtcttcaatttcctcaaagacgaaagaacccgtcctcagtgggatgttctttcaaacggaaacgcagtgcaagaagttgctcacatctcaaacggatcacatcctggaaactgcatatcggttctacgtggatccaatgcaacacatagcaacaacatgcttattctgcaagaaagctcaacagactcatcaggagcatttgtggtctacagtccagtggatttagcagcattgaacatcgcaatgagcggtgaagatccttcttatattcctctcttgtcctcaggtttcacaatctcaccagatggaaatggctcaaactctgaacaaggaggagcctcgacgagctcaggacgggcatcagctagcggttcgttgataacggttgggtttcagataatggtaagcaatttaccgacggcaaaactgaatatggagtcggtggaaacggttaataacctgataggaacaactgtacatcaaattaaaaccgccttgagcggtcctacagcttcaactacagcttga

SEQ ID NO: 2886 - protein, 722 aa, Arabidopsis thaliana
  G2543
MSFVVGVGGSGSGSGGDGGGSHHHDGSETDRKKKRYHRHTAQQIQRLESSFKECPHPDEKQRNQLSRELGLAPRQIKFWFQNRRTQLKAQHERADNSALKAENDKIRCENIAIREALKHAICPNCGGPPVSEDPYFDEQKLRIENAHLREELERMSTIASKYMGRPISQLSTLHPMHISPLDLSMTSLTGCGPFGHGPSLDFDLLPGSSMAVGPNNNLQSQPNLAISDMDKPIMTGIALTAMEELLRLLQTNEPLWTRTDGCRDILNLGSYENVFPRSSNRGKNQNFRVEASRSSGIVFMNAMALVDMFMDCVKWTELFPSIIAASKTLAVISSGMGGTHEGALHLLYEEMEVLSPLVATREFCELRYCQQTEQGSWIVVNVSYDLPQFVSHSQSYRFPSGCLIQDMPNGYSKVTWVEHIETEEKELVHELYREIIHRGIAFGADRWVTTLQRMCERFASLSVPASSSRDLGGVILSPEGKRSMMRLAQRMISNYCLSVSRSNNTRSTVVSELNEVGIRVTAHKSPEPNGTVLCAATTFWLPNSPQNVFNFLKDERTRPQWDVLSNGNAVQEVAHISNGSHPGNCISVLRGSNATHSNNMLILQESSTDSSGAFVVYSPVDLAALNIAMSGEDPSYIPLLSSGFTISPDGNGSNSEQGGASTSSGRASASGSLITVGFQIMVSNLPTAKLNMESVETVNNLIGTTVHQIKTALSGPTASTTA

SEQ ID NO: 2887 - DNA, 1182 bp, Arabidopsis thaliana
  G2552
cacaaatggaaggaagagtcaacgctctgtcaaacataaacgatctcgaacttcacaatttcttggtcgatccaaacttcgatcagttcataaacctcataagaggagatcatcaaaccattgacgaaaacccagttcttgatttcgatcttggtccattacaaaacagcccctgtttcatagacgagaaccagttcatcccaacacctgtcgatgacctcttcgacgaattgcctgacttagactccaacgttgctgaatcattccgtagcttcgacggtgatagtgttagagccggtggtgaagaagatgaagaagattacaacgacggtgatgattcttcagccactactacgaataatgatgggacccgtaagacgaagactgatcggtctaggactttgatctctgagagaagaaggagagggcgtatgaaggataagctttatgcattgagatctcttgttcccaatattactaagatggataaagcatccattgttggagatgcagtgttgtatgttcaagaacttcagtcacaagcgaagaaactcaaatccgatatcgcgggtcttgaagcttctttaaactctactggagggtaccaagaacatgctcctgatgctcaaaagactcaaccttttcgcggtatcaatcctcctgcttccaaaaaaatcattcagatggatgttatacaagtggaggagaaagggttttatgtgagattggtgtgtaacaaaggagaaggtgttgctccatctctttacaagtctttggagtctcttacaagtttccaagtgcagaactctaacctaagctctccttctccggacacatacctcttaacatataccttagatgggacatgcttcgaacagagcttaaacttgcctaacctgaagctgtggatcactggatcacttttaaatcaaggttttgaattcatcaagtcatttacttgattctataacgcttgctctaacgtgagtcaaatccggttctgcactatattgattgtgtacctttcttacatgtttcataacttccagggctctaatttctattctagtgatgatgtaaccgagattgttgattctctattgaataaacaccatgttatatagtaatttagcgacaaattgtatggttaaatgaagtaatatttatgttttgtttataaaa

SEQ ID NO: 2888 - protein, 318 aa, Arabidopsis thaliana
  G2552
MEGRVNALSNINDLELHNFLVDPNFDQFINLIRGDHQTIDENPVLDFDLGPLQNSPCFIDENQFIPTPVDDLFDELPDLDSNVAESFRSFDGDSVRAGGEEDEEDYNDGDDSSATTTNNDGTRKTKTDRSRTLISERRRRGRMKDKLYALRSLVPNITKMDKASIVGDAVLYVQELQSQAKKLKSDIAGLEASLNSTGGYQEHAPDAQKTQPFRGINPPASKKIIQMDVIQVEEKGFYVRLVCNKGEGVAPSLYKSLESLTSFQVQNSNLSSPSPDTYLLTYTLDGTCFEQSLNLPNLKLWITGSLLNQGFEFIKSFT

SEQ ID NO: 2889 - DNA, 1012 bp, Arabidopsis thaliana
  G2573
ccagatttaatttgagactctcaaagaaacaccatggaagaagagcaacctccggccaagaaacgaaacatggggagatctagaaaaggttgcatgaaaggtaaaggcggtccagagaacgccacgtgtactttccgtggagttaggcaacggacttggggtaaatgggtggctgagatccgtgagcctaaccgtgggactcgtctctggctcggcacgtttaatacctcggtcgaggccgccatggcttacgatgaagccgctaagaaactctatggacacgaggctaaactcaacttggtgcacccacaacaacaacaacaagtagtagtgaacagaaacttgtctttttctggccacgggtcgggttcttgggcttataataagaagctcgatatggttcatgggttggaccttggtctcggccaggcaagttgttcacgaggttcttgctcagagagatcgagttttctacaagaagatgatgatcatagtcataatcgatgttcgtcttcaagtggttcgaatctttgttggttattacctaaacaaagtgattcacaagatcaagagaccgttaatgctacgactagttatggcggtgaaggcggtggtggctctacgttaacgttttcgaccaatttgaaaccaaagaatttgatgagtcagaattatggattatacaatggagcttggtctaggtttcttgtggggcaagaaaagaagacggaacatgacgtgtcatcgtcgtgtggatcgtcggacaacaaggagagtatgttggttcctagttgcggcggagagaggatgcataggccggagttggaagagcgaacaggatatttggaaatggatgatcttttggagattgatgatttaggtttgttgattggcaaaaatggagatttcaagaattggtgttgtgaagagtttcaacatccatggaattggttctgagagtttttatttattactattatttatcatacatatttcttatatttgacttagg

SEQ ID NO: 2890 - protein, 307 aa, Arabidopsis thaliana
  G2573
MEEEQPPAKKRNMGRSRKGCMKGKGGPENATCTFRGVRQRTWGKWVAEIREPNRGTRLWLGTFNTSVEAAMAYDEAAKKLYGHEAKLNLVHPQQQQQVVVNRNLSFSGHGSGSWAYNKKLDMVHGLDLGLGQASCSRGSCSERSSFLQEDDDHSHNRCSSSSGSNLCWLLPKQSDSQDQETVNATTSYGGEGGGGSTLTFSTNLKPKNLMSQNYGLYNGAWSRFLVGQEKKTEHDVSSSCGSSDNKESMLVPSCGGERMHRPELEERTGYLEMDDLLEIDDLGLLIGKNGDFKNWCCEEFQHPWNWF

SEQ ID NO: 2891 - DNA, 1379 bp, Arabidopsis thaliana
  G2589
aaagaaaagaaaaataaagataatgaggacgaagactaagttagtactcatacctgatagacactttcggagagccacattcaggaagaggaatgcagggataaggaagaaactccacgagctgacaactctctgtgacatcaaagcatgtgcggtaatctacagtccgttcgagaatccaacggtgtggccgtcaaccgaaggtgttcaagaggtgatttcggagttcatggagaagccggcgacagaacggtccaagacgatgatgagtcatgagactttcttgcgggaccaaatcaccaaagaacaaaacaaactagagagtctacgtcgtgaaaaccgagaaactcagcttaagcattttatgtttgattgcgttggaggcaagatgagtgagcaacagtatggtgcaagggaccttcaagatttaagtctttttactgatcaatatcttaatcagcttaatgccaggaagaagttccttacagaatatggtgagtcttcttcttctgttcctcctctgtttgatgttgcgggtgccaatcctcctgttgttgcagatcaagctgcggtaactgttcctcctttgtttgctgttgcgggtgccaatcttcctgttgttgctgatcaagctgcggtaactgttcctcctctgtttgctgttgcgggtgccaatcttcctgttgttgcagatcaagctgcggttaatgttcctactggatttcataacatgaatgtgaaccagaatcagtatgagccggttcagccctatgtccctactggttttagtgatcatattcaatatcagaatatgaacttcaatcaaaaccaacaagagccggttcattaccaggctcttgctgttgcgggtgccggtcttcctatgactcagaatcagtatgagcccgttcactaccagagtcttgctgtcgcgggtggcggtcttcctatgagtcagttgcagtatgagccggttcagccttatatccctactgtttttagtgataatgttcaatatcagcatatgaatttgtatcaaaatcaacaagagccggttcactaccaagctcttggtgttgcaggtgccggtcttcctatgaatcagaatcagtatgagccggttcagccctatgtccctactggttttagtgatcattttcagtttgagaatatgaatttgaatcaaaatcaacaggagccggttcaataccaagctcctgttgattttaatcatcagattcaacaaggaaactatgatatgaatttgaaccagaatatgagtttggatccaaatcagtatccgtttcaaaatgatccattcatgaatatgttgacagaatatccttatgaataagcgggttatgttggagagcatgcac

SEQ ID NO: 2892 - protein, 443 aa, Arabidopsis thaliana
  G2589
MRTKTKLVLIPDRHFRRATFRKRNAGIRKKLHELTTLCDIKACAVIYSPFENPTVWPSTEGVQEVISEFMEKPATERSKTMMSHETFLRDQITKEQNKLESLRRENRETQLKHFMFDCVGGKMSEQQYGARDLQDLSLFTDQYLNQLNARKKFLTEYGESSSSVPPLFDVAGANPPVVADQAAVTVPPLFAVAGANLPVVADQAAVTVPPLFAVAGANLPVVADQAAVNVPTGFHNMNVNQNQYEPVQPYVPTGFSDHIQYQNMNFNQNQQEPVHYQALAVAGAGLPMTQNQYEPVHYQSLAVAGGGLPMSQLQYEPVQPYIPTVFSDNVQYQHMNLYQNQQEPVHYQALGVAGAGLPMNQNQYEPVQPYVPTGFSDHFQFENMNLNQNQQEPVQYQAPVDFNHQIQQGNYDMNLNQNMSLDPNQYPFQNDPFMNMLTEYPYE

SEQ ID NO: 2893 - DNA, 1194 bp, Arabidopsis thaliana
  G2687
ctctgtctctcgtatctttctactactctgtttcttgaattctaatgaacaacatcgacgacgcaaagacggagacttcagtgtcttcaggttcaagcgactctttcttgcctctcaagaaacgcatgagacttgatgacgaaccagaaaacgccctagtggtttcgtcttcaccaaagacggttgtggcttctggcaatgtcaagtacaaaggagtcgttcagcaacagaacggtcattggggtgcccagatttacgcagaccacaaaaggatttggcttggaactttcaaatccgctgatgaagccgccacggcttacgatagtgcatctatcaaactccgaagctttgacgctaactcgcaccggaacttcccttggtctacaatcactctcaacgaaccagactttcaaaattgctacacaacagagactgtgttgaacatgatcagagacggttcgtaccaacacaaattcagagattttctcagaatcagatctcagattgttgcgagtatcaacatcgggggaccaaaacaagcccgaggagaagtgaatcaagaatcagacaagtgtttttcttgcacacagctttttcagaaggaattgacaccgagcgatgtagggaaactaaataggcttgtgatacctaaaaagtatgcagtgaagtatatgcctttcataagcgctgatcaaagcgagaaagaagagggtgaaatagtaggatctgtggaagatgtggaggttgtgttttacgacagagcaatgagacaatggaagtttaggtattgttactggaaaagtagccagagctttgtcttcaccagaggatggaatagtttcgtgaaggagaagaatctcaaggagaaggatgttattgccttctacacttgcgatgtcccgaacaatgtgaagacattagaaggtcaaagaaagaacttcttgatgatcgatgttcattgcttttcagacaacggttccgtggtagctgaggaagtaagtatgacggttcatgacagttcagtgcaagtaaagaaaacagaaaacttggttagctccatgttagaagataaagaaaccaaatcagaggagaacaaaggagggtttatgctgtttggtgtaaggatcgaatgtccttagggaatttttctttaaaagtttcttacttcaactagaacttgttttacttgtacct

SEQ ID NO: 2894 - protein, 364 aa, Arabidopsis thaliana
  G2687
MNNIDDAKTETSVSSGSSDSFLPLKKRMRLDDEPENALVVSSSPKTVVASGNVKYKGVVQQQNGHWGAQIYADHKRIWLGTFKSADEAATAYDSASIKLRSFDANSHRNFPWSTITLNEPDFQNCYTTETVLNMIRDGSYQHKFRDFLRIRSQIVASINIGGPKQARGEVNQESDKCFSCTQLFQKELTPSDVGKLNRLVIPKKYAVKYMPFISADQSEKEEGEIVGSVEDVEVVFYDRAMRQWKFRYCYWKSSQSFVFTRGWNSFVKEKNLKEKDVIAFYTCDVPNNVKTLEGQRKNFLMIDVHCFSDNGSVVAEEVSMTVHDSSVQVKKTENLVSSMLEDKETKSEENKGGFMLFGVRIECP

SEQ ID NO: 2895 - DNA, 1338 bp, Arabidopsis thaliana
  G2713
atgtcgtttcgaggcattgttcaagatttgagagatgggtttgggagcttgtcaaggaggagtttcgattttaggctctcgagtcttcataaagggaaagctcagggttcttcgttccgtgagtattcgtcatcccgtgatctcttgtcgcctgtgatagttcagacaagtagatgggctaatcttcctccagagttactctttgatgtgatcaaaagattagaggaaagtgagagtaattggcctgcaagaaaacatgttgtggcttgtgcttcggtttgtcggtcttggagagctatgtgccaagagattgttttggggcctgaaatctgtgggaaactcactttccctgtttccctcaaacagccagggcctcgtgatgcaatgattcagtgtttcatcaaaagggataaatcaaagctaacatttcacctttttctttgtttaagtcccgctctattagtggagaatgggaaatttcttctttcagctaaaagaactcgtagaactactcgaaccgagtacattatctccatggatgctgataacatctcaagatccagcaactcttacctcggaaagctcagatcaaacttccttgggacaaagttcttggtgtacgacacgcaaccaccaccaaacacatcttcgagcgcacttatcactgatcgaacaagccgaagcaggtttcactccagacgagtttctcctaaagtaccatccggaagctacaacattgctcaaatcacctatgagctcaacgtgttgggcacacgcgggccacgacgaatgcactgcatcatgaactccatcccaatttcatcgctcgaaccaggcggttcagtccctaaccaacccgagaaactcgtccctgcaccatactctctcgacgactcattccgcagtaacatctccttctccaaatcatcatttgaccaccgctccctcgatttcagcagttctagattctccgaaatgggaatatcctgcgacgacaacgaagaagaagcgagtttcagaccgttgattctaaagaacaagcagccaaggtggcacgagcagttgcaatgctggtgtttgaatttccgcggacgtgtgacagttgcatcggttaagaatttccagcttgtagcagcaagacagccgcagcctcaagggacaggtgcagcagcagcaccaacaagtgcacctgctcaccctgagcaagacaaggtgattctccagtttggtaaagtagggaaagatatgttcacaatggactataggtatccattatcggcgtttcaggcgtttgcgatatgcttaagcagctttgacaccaagcttgcttgtgaatag

SEQ ID NO: 2896 - protein, 445 aa, Arabidopsis thaliana
  G2713
MSFRGIVQDLRDGFGSLSRRSFDFRLSSLHKGKAQGSSFREYSSSRDLLSPVIVQTSRWANLPPELLFDVIKRLEESESNWPARKHVVACASVCRSWRAMCQEIVLGPEICGKLTFPVSLKQPGPRDAMIQCFIKRDKSKLTFHLFLCLSPALLVENGKFLLSAKRTRRTTRTEYIISMDADNISRSSNSYLGKLRSNFLGTKFLVYDTQPPPNTSSSALITDRTSRSRFHSRRVSPKVPSGSYNIAQITYELNVLGTRGPRRMHCIMNSIPISSLEPGGSVPNQPEKLVPAPYSLDDSFRSNISFSKSSFDHRSLDFSSSRFSEMGISCDDNEEEASFRPLILKNKQPRWHEQLQCWCLNFRGRVTVASVKNFQLVAARQPQPQGTGAAAAPTSAPAHPEQDKVILQFGKVGKDMFTMDYRYPLSAFQAFAICLSSFDTKLACE

SEQ ID NO: 2897 - DNA, 894 bp, Arabidopsis thaliana
  G2720
atggaagcgaagaaggaagagataaagaaaggtccatggaaagccgaagaagacgaagtactcatcaaccatgtcaagagatacggtcctcgtgattggagctccattcgatccaaaggtcttcttcaacgcaccggcaaatcctgtcgtcttcgttgggtcaataaactccgtcccaatctcaaaaatggatgcaagttctcggctgacgaagagaggactgtgattgagttacaatctgagtttggtaacaaatgggcgagaatcgctacgtatctaccgggaagaactgataacgatgtgaagaatttctggagtagcagacaaaagagactcgctaggattcttcataactcctctgatgcatcgagttcgagtttcaatcccaaatcttcttcttctcatcgactcaagggcaaaaacgtcaaaccaatccgtcaatcctctcagggttttggtttggttgaggaagaggttacagtttcttcttcatgttcccagatggttccttattcatctgatcaagttggtgatgaagtcttgaggttgccggatttgggtgttaagttagagcatcagcctttcgcttttggcactgatcttgtcctagcagagtactctgactcacagaatgatgcaaatcagcaagcaatcagccctttctctccagaaagcagagagcttttggctagacttgacgaccctttttactatgatatacttggaccagctgattcttctgagccattgttcgctctccctcagccgttcttcgagccttcgcctgtgccgagaagatgcagacatgtttcaaaggatgaagaagctgatgttttcttagacgatttcccagctgacatgtttgatcaggttgatccaatcccaagtccttag

SEQ ID NO: 2898 - protein, 297 aa, Arabidopsis thaliana
  G2720
MEAKKEEIKKGPWKAEEDEVLINHVKRYGPRDWSSIRSKGLLQRTGKSCRLRWVNKLRPNLKNGCKFSADEERTVIELQSEFGNKWARIATYLPGRTDNDVKNFWSSRQKRLARILHNSSDASSSSFNPKSSSSHRLKGKNVKPIRQSSQGFGLVEEEVTVSSSCSQMVPYSSDQVGDEVLRLPDLGVKLEHQPFAFGTDLVLAEYSDSQNDANQQAISPFSPESRELLARLDDPFYYDILGPADSSEPLFALPQPFFEPSPVPRRCRHVSKDEEADVFLDDFPADMFDQVDPIPSP

SEQ ID NO: 2899 - DNA, 651 bp, Arabidopsis thaliana
  G2724
atggaaatagaaataaggagaggtccatggactgtggaagaagacatgaagctcgtcagttacatttctcttcacggtgaaggaagatggaactccctctctcgttctgctggactgaatagaacggggaaaagttgcagattgcggtggctaaattatctccggccggatatccgccgtggagacatatcccttcaagaacaatttatcatccttgaactccattctcgttggggaaatcggtggtcaaagattgctcaacatttaccgggaagaacagataacgagataaagaattattggagaacacgtgttcaaaagcatgcaaaacttctaaaatgtgacgtgaacagcaagcaattcaaagacaccatcaaacatctctggatgcctcgtctcatcgagagaatcgccgccactcaaagtgtccaatttacctctaaccactactcgcctgagaactccagcgtcgccaccgccacgtcatcaacgtcgtcgtctgaggctgtgagatcgagtttctacggtggtgatcaggtggaatttggaacgttggatcatatgacaaatggtggttattggttcaacggcggagatacgtttgaaactttgtgtagttttgacgagctcaacaagtggctcatacagtag

SEQ ID NO: 2900 - protein, 216 aa, Arabidopsis thaliana
  G2724
MEIEIRRGPWTVEEDMKLVSYISLHGEGRWNSLSRSAGLNRTGKSCRLRWLNYLRPDIRRGDISLQEQFIILELHSRWGNRWSKIAQHLPGRTDNEIKNYWRTRVQKHAKLLKCDVNSKQFKDTIKHLWMPRLIERIAATQSVQFTSNHYSPENSSVATATSSTSSSEAVRSSFYGGDQVEFGTLDHMTNGGYWFNGGDTFETLCSFDELNKWLIQ

SEQ ID NO: 2901 - DNA, 1878 bp, Arabidopsis thaliana
  G2787
tctcagagcaaaaaacaaaaaaaaagaaaaaaaaaccctaaatctaaatctcaccttccacctctgtcttttttttttttgttcttttttttttttttactgtatcttctcttctctttgctctgcaaaaatctcacatccatggatccatctcttggtgatcctcatcatcctcctcagttcaccccttttcctcattttcccacctccaatcatcatcctttaggaccaaatccgtacaataaccatgtcgtcttccaaccgcagccgcaaacgcaaacgcaaatcccgcaaccgcagatgtttcagttatctccacatgtttcaatgccccaccctccttactccgaaatgatttgcgctgcgattgcggcgttaaacgaaccggatggttcgagcaagatggcaatttcgagatacatcgagagatgttacaccggtttaacttctgctcatgctgctttgttgactcaccatctcaagactttgaagaccagtggtgttctttctatggttaagaaatcttacaaaattgctggttcttctactcctcctgctagtgtagctgttgctgctgctgccgccgctcaaggtctcgatgttcccagatctgagattctccattcaagtaacaacgatcccatggcttctggctctgcttctcagcctctgaaacgaggtcgtggtcgtcctcctaagcctaaacctgaatctcaaccacaaccactacagcaacttccaccgaccaatcaagtccaggctaacggacagccaatctgggaacagcagcaagttcaatcacctgttccggttccgactccggttacagagtcggcgaagagaggacctggtcgtccaaggaagaacggttctgctgctcctgctactgcaccaatcgttcaagcttcggttatggctggaattatgaaacgtagaggtagaccaccgggtcgtcgagctgctgggagacagaggaagcccaaatccgtttcttctactgcctctgtgtatccttatgttgctaatggtgctagacgcagaggaaggcctaggagagttgttgaccctagcagtattgttagtgttgctccagtaggtggtgaaaatgtggcagcggttgcgccagggatgaagcgtggacgtggacgaccacctaagattggtggtgttatcagtaggcttattatgaagcctaagagaggacgaggacgtcctgtaggtagacccagaaagattggaacatcagtcacgactgggacacaagattctggagaactcaagaagaagtttgatatttttcaagagaaagtgaaagaaattgtgaaggtgttgaaggatggagttacaagtgagaatcaagcagtggtgcaagccataaaagatctggaagcactaacagtgacggagaccgttgagccacaagttatggaagaagtgcagccagaggagactgcagcaccacagactgaagctcaacaaactgaagctgctgagacacaaggaggacaagaagaaggacaagaaagagaaggagaaacacagacccagacagaagcagaggcaatgcaagaagctctgttctgaagaataataatgatctagaaaacaacctagacataatagccttggtgtttggcgttaggagtgtttttttttagttgttttaggtgttggaatcgcatcttaaattatataaaaatctataaggaattttaatttttctaggttttgttgtctgcagaagaagaaatagtagactcgttaatggtgttgttgtcggtgtgtctttaaccaaaccataagacgtggctgtaaattagcgatgtttctagtcttccatctttaataatctcttattgcgtctgtgcctttgttttt

SEQ ID NO: 2902 - protein, 480 aa, Arabidopsis thaliana
  G2787
MDPSLGDPHHPPQFTPFPHFPTSNHHPLGPNPYNNHVVFQPQPQTQTQIPQPQMFQLSPHVSMPHPPYSEMICAAIAALNEPDGSSKMAISRYIERCYTGLTSAHAALLTHHLKTLKTSGVLSMVKKSYKIAGSSTPPASVAVAAAAAAQGLDVPRSEILHSSNNDPMASGSASQPLKRGRGRPPKPKPESQPQPLQQLPPTNQVQANGQPIWEQQQVQSPVPVPTPVTESAKRGPGRPRKNGSAAPATAPIVQASVMAGIMKRRGRPPGRRAAGRQRKPKSVSSTASVYPYVANGARRRGRPRRVVDPSSIVSVAPVGGENVAAVAPGMKRGRGRPPKIGGVISRLIMKPKRGRGRPVGRPRKIGTSVTTGTQDSGELKKKFDIFQEKVKEIVKVLKDGVTSENQAVVQAIKDLEALTVTETVEPQVMEEVQPEETAAPQTEAQQTEAAETQGGQEEGQEREGETQTQTEAEAMQEALF

SEQ ID NO: 2903 - DNA, 1653 bp, Arabidopsis thaliana
  G2792
accaacaaaataaaagaaagaagcaaaaagaaaaagctcgaagataggaaaatgttaagggaagaatgtactccaagttcatcatggtgggaagatgttcaacatcatcataatgatcatgcaaactcgattagttcgacgtctttctaccataagagtagtaataataactcacacgccaacgctagctgtgaagaagacaatctctccgtctctaccgtacgcgcttcgaatcgtttggacctaaccgctgaatcctccaatcatcactctctctcggcttcgaatcagcctgcctcctcctccgatgagttgcttcgcgaccatgtagtatcttctcataatcatctatggagtcttgccttcttgcctggtagaagcttaggagatcaaatgatggatcatcatcatcacatagcatcaagaaattcatcaacaacatcagaattaccatcattcgagccagcgtgccataacggtaatggtaacggttggatctatgacccaaatcaagttaggtacgatcaaagtagtgaccaacggctgtcaaagttgacggatcttgtaggcaagcactggtcaattgcaccaccgaataatcccgacatgaaccataaccttcatcatcacttcgatcatgatcattctcaaaacgacgacatttctatgtacagacaagccttggaggtgaaaaatgaggaagatctttgttacaataatggctcaagtggtggtggttccttgttccatgatcctatagaaagttctagaagtttccttgatataaggttaagtaggccattaacggatattaatccgtcatttaagccatgctttaaggccttaaacgtatccgagtttaacaagaaagaacatcaaacggcatctctggcagcagtgagactgggaacaacaaacgctggaaaaaagaagagatgtgaagaaatttccgatgaggtttcaaagaaggccaagtgcagtgagggctctacactttcgccagagaaggaactacccaaagccaaacttcgagacaagatcacgactctacagcaaattgtgtctccctttggaaagactgatactgcttctgtgcttcaagaggccatcacttacataaatttttatcaagagcaagttaagctgctaagcactccttatatgaagaattcatcaatgaaggatccatgggggggatgggacagagaagatcacaacaaaaggggaccgaagcatcttgatctaaggagtagagggctttgtttggttcctatttcatataccccaatcgcataccgcgataacagtgcaactgactactggaatcccacgtatagaggttctttgtatcgttagtgactagtatagcaaaaagtgtgtagagagaaagatttgattaaattatggtagtggtaaaccattccaaacatcgatcattttatagggagcaagcagtaaaacgggagaagagtatgtgtacataaagtatatgcatattaatcattggggtcacacttctttgatttgcaattgttcttgcgtaacctaaaacattgtgttatggtcatatatagaataatacattaatattggagtttgaattagatatactacaatgtaataaaaagtagttaattaatggcatattccttg

SEQ ID NO: 2904 - protein, 434 aa, Arabidopsis thaliana
  G2792
MLREECTPSSSWWEDVQHHHNDHANSISSTSFYHKSSNNNSHANASCEEDNLSVSTVRASNRLDLTAESSNHHSLSASNQPASSSDELLRDHVVSSHNHLWSLAFLPGRSLGDQMMDHHHHIASRNSSTTSELPSFEPACHNGNGNGWIYDPNQVRYDQSSDQRLSKLTDLVGKHWSIAPPNNPDMNHNLHHHFDHDHSQNDDISMYRQALEVKNEEDLCYNNGSSGGGSLFHDPIESSRSFLDIRLSRPLTDINPSFKPCFKALNVSEFNKKEHQTASLAAVRLGTTNAGKKKRCEEISDEVSKKAKCSEGSTLSPEKELPKAKLRDKITTLQQIVSPFGKTDTASVLQEAITYINFYQEQVKLLSTPYMKNSSMKDPWGGWDREDHNKRGPKHLDLRSRGLCLVPISYTPIAYRDNSATDYWNPTYRGSLYR

SEQ ID NO: 2905 - DNA, 1140 bp, Arabidopsis thaliana
  G2893
aaatcataaaagcctctctcttagtctatttttatctcacggctctctctcccctctctacacacacaaacacaaataaagcgtaaaactgaaatattttaattacaattagaaagagaacatattaatatgtcaaatataacaaagaagaagtgtaatggaaatgaagagggtgcagagcagaggaaagggccttggacactcgaggaagacactcttctcaccaattacatttcccataacggtgaaggccgatggaatctgctcgctaaatcttctgggctaaagagagcaggaaaaagttgtagattgagatggttgaattaccttaaacccgacataaagcgtgggaatctcactcctcaagaacaacttttaatccttgagctccattctaaatggggtaataggtggtcaaaaatttcgaagtatttaccaggaagaacagacaacgatatcaaaaactactggagaactagagtccagaaacaagcacgccagctcaacatagattccaatagccacaagttcatagaagttgttcgtagcttttggtttccaagactgatcaacgagattaaagacaactcatacaccaacaatattaaagctaatgctcctgatttacttggaccaattttacgagacagcaaagatttgggtttcaacaacatggattgttccacttccatgtcagaagatctcaagaaaacttcacaattcatggatttttctgatcttgaaaccacaatgtccttggaaggatcacgagggggtagtagtcaatgtgtgagtgaggtttatagctccttcccttgcctagaggaggagtacatggtggccgttatgggcagttcagacatttcagcattgcatgattgtcacgtggctgattccaagtacgaggatgatgtgacacaagatctaatgtggaacatggatgacatttggcagtttaacgagtatgcacactttaattaggttatattatatttatgtacttcttacaacttggaggggtttatcggtcttttattaaattttgattgttttggattccttaaaaatgtgttcttattatagtttttaatgaaaaaaatgtttaagcgcaaaaaaaaaaaaaaaaaaaaaaaaaaaaaa

SEQ ID NO: 2906 - protein, 283 aa, Arabidopsis thaliana
  G2893
MSNITKKKCNGNEEGAEQRKGPWTLEEDTLLTNYISHNGEGRWNLLAKSSGLKRAGKSCRLRWLNYLKPDIKRGNLTPQEQLLILELHSKWGNRWSKISKYLPGRTDNDIKNYWRTRVQKQARQLNIDSNSHKFIEVVRSFWFPRLINEIKDNSYTNNIKANAPDLLGPILRDSKDLGFNNMDCSTSMSEDLKKTSQFMDFSDLETTMSLEGSRGGSSQCVSEVYSSFPCLEEEYMVAVMGSSDISALHDCHVADSKYEDDVTQDLMWNMDDIWQFNEYAHFN

SEQ ID NO: 2907 - protein, 16 aa, Arabidopsis thaliana
  misc_feature (3)..(3): Xaa can be Lys or Arg
  misc_feature (8)..(8): Xaa can be any naturally occurring amino acid
  misc_feature (11)..(11): Xaa can be any naturally occurring amino acid
  CBF conserved consecutive amino acid residues
PKXPAGRXKFXETRHP

SEQ ID NO: 2908 - protein, 5 aa, Arabidopsis thaliana
  CBF conserved consecutive amino acid residues
DSAWR

SEQ ID NO: 2909 - protein, 7 aa, Arabidopsis thaliana
HPIYRGV

SEQ ID NO: 2910 - protein, 8 aa, Arabidopsis thaliana
MAEGMLLP
